(12) United States Patent
Dillon

(10) Patent No.: US 7,135,290 B2
(45) Date of Patent: Nov. 14, 2006

(54) METHODS AND COMPOSITIONS FOR EVOLVING HYDROGENASE GENES

(75) Inventor: Harrison Fields Dillon, Palo Alto, CA (US)

(73) Assignee: Solazyme, Inc., Menlo Park, CA (US)

( * ) Notice: Subject to any disclaimer, the term of this patent is extended or adjusted under 35 U.S.C. 154(b) by 296 days.

(21) Appl. No.: 10/411,910

(22) Filed: Apr. 12, 2003

(65) Prior Publication Data

US 2004/0209256 A1    Oct. 21, 2004

(51) Int. Cl.
*C12Q 1/68*   (2006.01)
(52) U.S. Cl. .......................................... 435/6; 435/189
(58) Field of Classification Search .................. 435/6, 435/29, 252.3, 471, 320.1, 91.1; 536/23.1
See application file for complete search history.

(56) References Cited

U.S. PATENT DOCUMENTS

| 4,476,105 A | | 10/1984 | Greenbaum |
| 5,871,952 A | * | 2/1999 | Ghirardi et al. .............. 435/34 |
| 6,180,406 B1 | * | 1/2001 | Stemmer .................... 435/440 |

OTHER PUBLICATIONS

Kosourov, Sustained hydrogen photoproduction by Chlamydomonas reinhardtii: Effects of culture parameters, Biotechnology and Bioengineering, Jun. 30, 2002, 731-40, 78(7).
Happe, Differential regulation of the Fe-hydrogenase during anaerobic adaptation in the green alga Chlamydomonas reinhardtii, Eur. J. Biochem. Feb. 2002, 1022-32, 269(3).
Zhang, Biochemical and morphological characterization of sulfur-deprived and H2-producing Chlamydomonas reinhardtii (green alga), Planta, Feb. 2002, 552-61, 214(4).
Ghirardi, Microalgae: a green source of renewable H2, Trends Biotechnol. Dec. 1, 2000, 506-11, 18(12).
Ahmann, Combinatorial Mutagenesis of a Bidirectional Hydrogenase in Chlamydomonas reinhardtii, Feb. 21, 2002, National Science Foundation Grant No. AWSFL008-DS3.

* cited by examiner

*Primary Examiner*—James Ketter
(74) *Attorney, Agent, or Firm*—Harrison Dillon

(57) ABSTRACT

The invention provides methods and compositions for engineering microbes to generate Hydrogen. Some methods of the invention involve recoding of hydrogenase genes followed by subjecting the recoded genes to annealing-based recombination methods. The invention further provides methods of mating organisms that are transformed with recoded and recombined hydrogenase genes with other organisms containing different genome sequences.

62 Claims, 17 Drawing Sheets

Figure 1

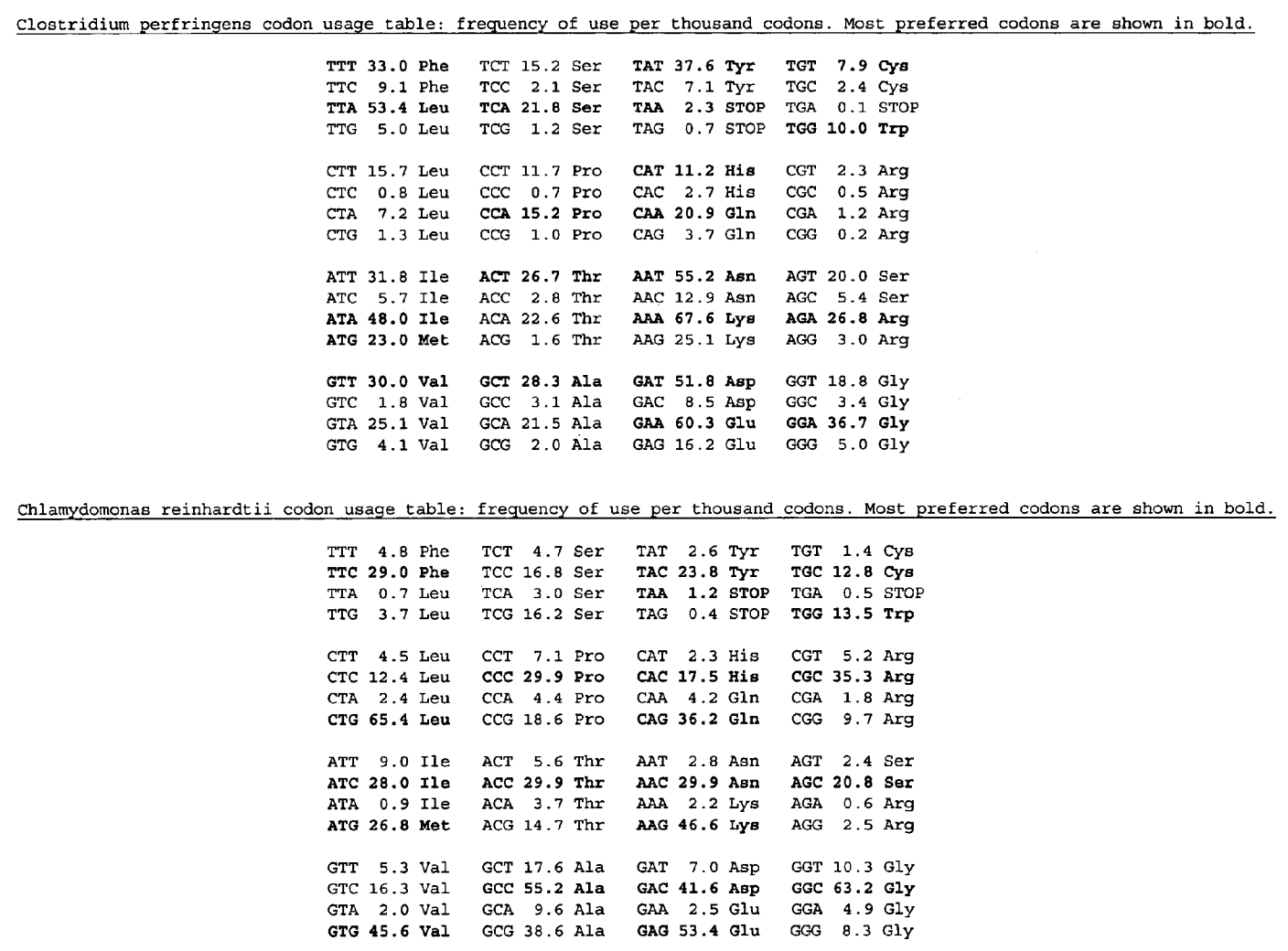

Clostridium perfringens codon usage table: frequency of use per thousand codons. Most preferred codons are shown in bold.

| | |

Figure 2

Entamoeba histolytica codon usage table: frequency of use per thousand codons. Most preferred codons are shown in bold.

| | | | | | | | |
|---|---|---|---|---|---|---|---|
| TTT 27.5 Phe | TCT 15.6 Ser | TAT 31.0 Tyr | TGT 19.4 Cys |
| TTC 13.8 Phe | TCC 1.6 Ser | TAC 4.4 Tyr | TGC 2.8 Cys |
| TTA 35.9 Leu | TCA 29.1 Ser | TAA 2.0 STOP | TGA 0.3 STOP |
| TTG 6.8 Leu | TCG 0.6 Ser | TAG 0.1 STOP | TGG 8.8 Trp |
| | | | |
| CTT 28.6 Leu | CCT 6.5 Pro | CAT 14.6 His | CGT 4.1 Arg |
| CTC 2.2 Leu | CCC 0.5 Pro | CAC 2.7 His | CGC 0.1 Arg |
| CTA 2.4 Leu | CCA 29.3 Pro | CAA 35.7 Gln | CGA 2.7 Arg |
| CTG 0.6 Leu | CCG 0.2 Pro | CAG 1.7 Gln | CGG 0.2 Arg |
| | | | |
| ATT 58.2 Ile | ACT 25.7 Thr | AAT 44.4 Asn | AGT 14.7 Ser |
| ATC 6.0 Ile | ACC 3.4 Thr | AAC 8.7 Asn | AGC 1.9 Ser |
| ATA 10.6 Ile | ACA 27.0 Thr | AAA 60.8 Lys | AGA 28.9 Arg |
| ATG 26.6 Met | ACG 1.0 Thr | AAG 20.7 Lys | AGG 1.4 Arg |
| | | | |
| GTT 44.1 Val | GCT 32.0 Ala | GAT 45.9 Asp | GGT 17.7 Gly |
| GTC 5.0 Val | GCC 3.5 Ala | GAC 8.2 Asp | GGC 0.8 Gly |
| GTA 15.5 Val | GCA 30.1 Ala | GAA 66.1 Glu | GGA 47.8 Gly |
| GTG 2.5 Val | GCG 0.4 Ala | GAG 6.0 Glu | GGG 2.3 Gly |

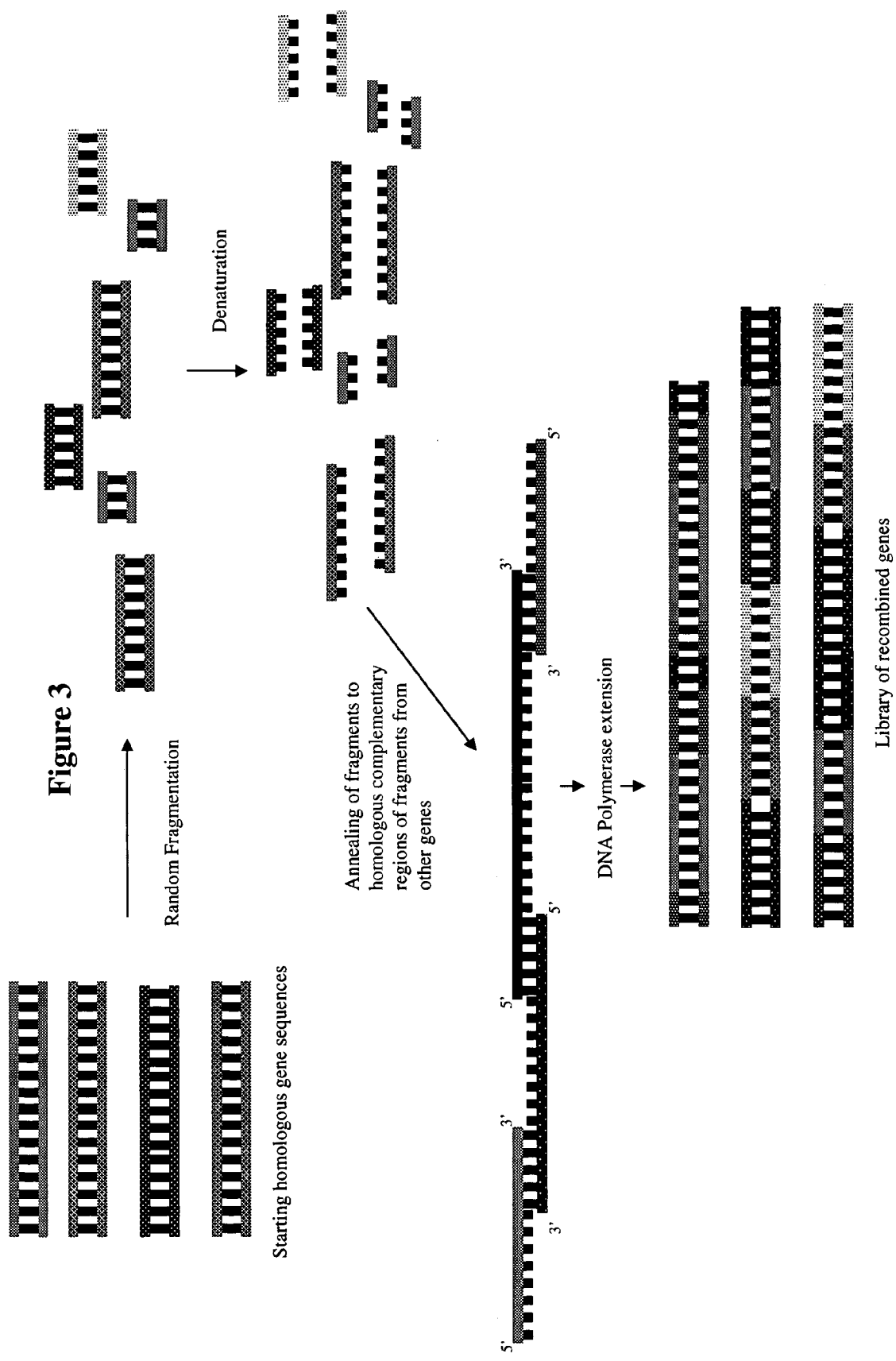

Fe-hydrogenase Recoding Key

C. Reinhardtii Codon Usage Table: most preferred codons are shown underlined and in bold-face type

| | | | |
|---|---|---|---|
| TTT 4.8 Phe | TCT 4.7 Ser | TAT 2.6 Tyr | TGT 1.4 Cys |
| TTC 29.0 Phe | TCC 16.8 Ser | TAC 23.8 Tyr | TGC 12.8 Cys |
| TTA 0.7 Leu | TCA 3.0 Ser | TAA 1.2 STOP | TGA 0.5 STOP |
| TTG 3.7 Leu | TCG 16.2 Ser | TAG 0.4 STOP | TGG 13.5 Trp |
| | | | |
| CTT 4.5 Leu | CCT 7.1 Pro | CAT 2.3 His | CGT 5.2 Arg |
| CTC 12.4 Leu | CCC 29.9 Pro | CAC 17.5 His | CGC 35.3 Arg |
| CTA 2.4 Leu | CCA 4.4 Pro | CAA 4.2 Gln | CGA 1.8 Arg |
| CTG 65.4 Leu | CCG 18.6 Pro | CAG 36.2 Gln | CGG 9.7 Arg |
| | | | |
| ATT 9.0 Ile | ACT 5.6 Thr | AAT 2.8 Asn | AGT 2.4 Ser |
| ATC 28.0 Ile | ACC 29.9 Thr | AAC 29.9 Asn | AGC 20.8 Ser |
| ATA 0.9 Ile | ACA 3.7 Thr | AAA 2.2 Lys | AGA 0.6 Arg |
| ATG 26.8 Met | ACG 14.7 Thr | AAG 46.6 Lys | AGG 2.5 Arg |
| | | | |
| GTT 5.3 Val | GCT 17.6 Ala | GAT 7.0 Asp | GGT 10.3 Gly |
| GTC 16.3 Val | GCC 55.2 Ala | GAC 41.6 Asp | GGC 63.2 Gly |
| GTA 2.0 Val | GCA 9.6 Ala | GAA 2.5 Glu | GGA 4.9 Gly |
| GTG 45.6 Val | GCG 38.6 Ala | GAG 53.4 Glu | GGG 8.3 Gly |

Figure 4

```
Codons used to recode SEQ ID NOS:88-174 to obtain SEQ ID NOS: 195-281
A-Ala gcc    R-Arg cgc    N-Asn aac    D-Asp gac    C-Cys tgc    Q-Gln cag
E-Glu gag    G-Gly ggc    H-His cac    I-Ile atc    L-Leu ctg    K-Lys aag
M-Met atg    F-Phe ttc    P-Pro ccc    S-Ser agc    Stop taa    T-Thr acc
W-Trp tgg    Y-Tyr tac    V-Val gtg
```

Figure 6

Naturally Occurring Iterations of the Fe-hydrogenase FXXXGGVMEAAXR (SEQ ID NO: 347) motif

| 1. | | 2. |
|---|---|---|
| FGATGGVMEAALR | (SEQ ID NO: 352) | gi:144835 |
| FGVTGGVMEAALR | (SEQ ID NO: 353) | gi:40830 |
| FGTTGGVMEAALR | (SEQ ID NO: 354) | gi:488597 |
| FGVSGGVMEAALR | (SEQ ID NO: 355) | gi:130022069 |
| FGLTGGVMEAALR | (SEQ ID NO: 356) | gi:234474435 |
| FCTSGGVMEAALR | (SEQ ID NO: 357) | gi:234474512 |
| FGATGGVMEAAIR | (SEQ ID NO: 358) | gi:11127700 |
| FGVTGGVMEAAIR | (SEQ ID NO: 359) | gi:195478862 |
| FGNSGGVMEAAIR | (SEQ ID NO: 360) | gi:6650985 |
| FCATGGVMEAAVR | (SEQ ID NO: 361) | gi:1171116 |
| FGVTGGVMEAAVR | (SEQ ID NO: 362) | gi:236664246 |
| FAATGGVMEAASR | (SEQ ID NO: 363) | gi:11127700 |

1: Naturally occurring amino acid sequence of FXXXGGVMEAAXR (SEQ ID NO: 347) motif.

2: Protein database accession number of full length naturally occurring amino acid sequence containing the motif (from SEQ ID NOs: 1-87).

Figure 7

FABJGGVMEAAOR SEQ ID NO:364
FCBJGGVMEAAOR SEQ ID NO:365
FGBJGGVMEAAOR SEQ ID NO:366
FUAJGGVMEAAOR SEQ ID NO:367
FUVJGGVMEAAOR SEQ ID NO:368
FUNJGGVMEAAOR SEQ ID NO:369
FUTJGGVMEAAOR SEQ ID NO:370
FULJGGVMEAAOR SEQ ID NO:371
FUBTGGVMEAAOR SEQ ID NO:372
FUBSGGVMEAAOR SEQ ID NO:373
FUBJGGVMEAALR SEQ ID NO:374
FUBJGGVMEAAIR SEQ ID NO:375
FUBJGGVMEAAVR SEQ ID NO:376
FUBJGGVMEAASR SEQ ID NO:377

Amino Acid Key
B= A(Ala), V(Val), N(Asn), T(Thr), L(Leu)
J= T(Thr), S(Ser)
O= L(Leu), I(Ile), V(Val), S(Ser)
U= G(Gly), C(Cys), A(Ala)

Figure 8

Oligonucleotides encoding engineered iterations of the FXXXGGVMEAAXR (SEQ ID NO: 347) motif that do not naturally occur in known Fe-hydrogenase genes. Oligonucleotides utilize C. reinhardtii preferred codons specified in Figure 4.

```
FGNSGGVMEAALR(SEQ ID NO: 282)   ttcggcaacagcggcggcgtgatggaggccgccctgcgc   SEQ ID NO:283
FCATGGVMEAALR(SEQ ID NO: 284)   ttctgcgccaccggcggcgtgatggaggccgccctgcgc   SEQ ID NO:285
FAATGGVMEAALR(SEQ ID NO: 286)   ttcgccgccaccggcggcgtgatggaggccgccctgcgc   SEQ ID NO:287
FGTTGGVMEAAIR(SEQ ID NO: 288)   ttcggcaccaccggcggcgtgatggaggccgccatccgc   SEQ ID NO:289
FGVSGGVMEAAIR(SEQ ID NO: 290)   ttcggcgtgagcggcggcgtgatggaggccgccatccgc   SEQ ID NO:291
FGLTGGVMEAAIR(SEQ ID NO: 292)   ttcggcctgaccggcggcgtgatggaggccgccatccgc   SEQ ID NO:293
FCTSGGVMEAAIR(SEQ ID NO: 294)   ttctgcaccagcggcggcgtgatggaggccgccatccgc   SEQ ID NO:295
FCATGGVMEAAIR(SEQ ID NO: 296)   ttctgcgccaccggcggcgtgatggaggccgccatccgc   SEQ ID NO:297
FAATGGVMEAAIR(SEQ ID NO: 298)   ttcgccgccaccggcggcgtgatggaggccgccatccgc   SEQ ID NO:299
FGATGGVMEAAVR(SEQ ID NO: 300)   ttcggcgccaccggcggcgtgatggaggccgccgtgcgc   SEQ ID NO:301
FGNSGGVMEAAVR(SEQ ID NO: 302)   ttcggcaacagcggcggcgtgatggaggccgccgtgcgc   SEQ ID NO:303
FGTTGGVMEAAVR(SEQ ID NO: 304)   ttcggcaccaccggcggcgtgatggaggccgccgtgcgc   SEQ ID NO:305
FGVSGGVMEAAVR(SEQ ID NO: 306)   ttcggcgtgagcggcggcgtgatggaggccgccgtgcgc   SEQ ID NO:307
FGLTGGVMEAAVR(SEQ ID NO: 308)   ttcggcctgaccggcggcgtgatggaggccgccgtgcgc   SEQ ID NO:309
FCTSGGVMEAAVR(SEQ ID NO: 310)   ttctgcaccagcggcggcgtgatggaggccgccgtgcgc   SEQ ID NO:311
FAATGGVMEAAVR(SEQ ID NO: 312)   ttcgccgccaccggcggcgtgatggaggccgccgtgcgc   SEQ ID NO:313
FCATGGVMEAASR(SEQ ID NO: 314)   ttctgcgccaccggcggcgtgatggaggccgccagccgc   SEQ ID NO:315
FGVTGGVMEAASR(SEQ ID NO: 316)   ttcggcgtgaccggcggcgtgatggaggccgccagccgc   SEQ ID NO:317
FGATGGVMEAASR(SEQ ID NO: 318)   ttcggcgccaccggcggcgtgatggaggccgccagccgc   SEQ ID NO:319
FGNSGGVMEAASR(SEQ ID NO: 320)   ttcggcaacagcggcggcgtgatggaggccgccagccgc   SEQ ID NO:321
FGTTGGVMEAASR(SEQ ID NO: 322)   ttcggcaccaccggcggcgtgatggaggccgccagccgc   SEQ ID NO:323
FGVSGGVMEAASR(SEQ ID NO: 324)   ttcggcgtgagcggcggcgtgatggaggccgccagccgc   SEQ ID NO:325
FGLTGGVMEAASR(SEQ ID NO: 326)   ttcggcctgaccggcggcgtgatggaggccgccagccgc   SEQ ID NO:327
FCTSGGVMEAASR(SEQ ID NO: 328)   ttctgcaccagcggcggcgtgatggaggccgccagccgc   SEQ ID NO:329
```

Figure 9

```
         257     L   R   E   L   G   F   D   K   V   F   D   I   N   F   G   A   D   M   T   I   M   E   E   A   T   E   L   283 FRAGMENT OF SEQ ID NO: 10  (recoded)
         768     cctgcgcgagctgggcttcgacaaggtgttcgacatcaacttcggcgccgacatgaccatcatggaggaggccaccgagctg 849 FRAGMENT OF SEQ ID NO: 205 (recoded)
87.8%            ||||||  |||||||||||  ||||||||  ||||| ||||||||   |||||  || |||||||||||||||||||||
nucleotide       cctgcgccgcctgggcttcgacgaggtgttcgacgaggtgttcgacccctgtccgacccctgaccctgaccctgaccctgaccctgaccctgaccctgaccctgaccctgaccctgaccctg
identity         354     L   R   R   L   G   F   D   E   V   F   D   E   V   F   D   T   L   F   G   A   D   L   T   I   M   E   E   G   S   E   L   145 FRAGMENT OF SEQ ID NO: 24

257     L   R   E   L   G   F   D   K   V   F   D   I   N   F   G   A   D   M   T   I   M   E   E   A   T   E   L   283 FRAGMENT OF SEQ ID NO: 10  (wild-type)
         768     tttaagagaattaggttttgataaagtatttgatataaacttcggtgctgatatgacaataatggaagaagctactgagctt 849 FRAGMENT OF SEQ ID NO: 98  (wild-type)
56.1%            |  |||||   ||  |||  ||||  |||||   |||||||   ||||||    |||||    || || ||  |  |||
nucleotide       cctcccgccgcctcggcttttgacacggctgtttggcgcgaccgctgttttggcgccgagctgaccctgaccctgaccctgaccctgaccctgaccctgaccctgaccctgaccctgaccctgacc
identity         354     L   R   R   L   G   F   D   E   V   F   D   T   L   F   G   A   D   L   T   I   M   E   E   G   S   E   L   145 FRAGMENT OF SEQ ID NO: 24

294     P   M   L   T   S   C   C   P   S   W   V   R   E   V   E   N   Y   F   P   E   L   V   E   N   L   S   S   A   K   S   P   Q   325 FRAGMENT OF SEQ ID NO: 10
         880     cccatgctgaccagctgctgcccagctgtgcgcgaggtgggctgcgcgaggtgcgcgaggtgagcgagaactacttcccgagctggtggagaacctggtggagaacctgagcagcgccaagagccccaag 975 FRAGMENT OF SEQ ID NO: 205 (rcd)
74.0%            ||||| ||||| || |||||  ||||   ||||   |||||   ||| |||||||||  ||| |||||   ||||| ||
nucleotide       cccatgttcaccagctgctgcccacccggctgcgccccggctggatcgcatgctggagaagagctggaaatgctggagaagtccccccaggatcgcccccaggatcgcccccaggatcgcccccagg 585 FRAGMENT OF SEQ ID NO: 219 (rcd)
identity         490     P   M   F   T   S   C   C   P   G   W   I   A   M   L   E   K   S   Y   P   D   L   I   P   Y   V   V   S   S   C   K   S   P   Q   195 FRAGMENT OF SEQ ID NO: 24

294     P   M   L   T   S   C   C   P   S   W   V   R   E   V   E   N   Y   F   P   E   L   V   E   N   L   S   S   A   K   S   P   Q   325 FRAGMENT OF SEQ ID NO: 10
         880     ccaatgttaacttcatgttgtccatcatggggttagagaagttgaaaactacttcccagaattagtagaaaatcttcatcagctaaatcaccacaa 975 FRAGMENT OF SEQ ID NO: 98  (w-t)
42.7%            || ||||| |  ||  ||| ||| || |||  ||||   ||| |  | | ||| ||    ||||  | | |   |||    |||
nucleotide       cccatgttcaccagctgctgcccggctgccccggctggatcgctatgctggagaaatcttacccgacctgatcccctacgtgagcagctgcaagagctgcaagagccccaag 585 FRAGMENT OF SEQ ID NO: 112 (w-t)
identity         490     P   M   F   T   S   C   C   P   G   W   I   A   M   L   E   K   S   Y   P   D   L   I   P   Y   V   V   S   S   C   K   S   P   Q   195 FRAGMENT OF SEQ ID NO: 24
```

Most highly conserved amino acids in Fe-hydrogenases are shown in bold (see Happe et. al, Eur J Biochem (2002) Feb;269(3):1022-32).

Figure 10

```
              I   D   P   K   K   V   F   T   V   T   V   M   P   C   T   S   K   K   F   E   A   D   R
        342   catcgacccaagaaggtgttcaccgtgaccgtgatgcctgcaccagcaagaagttcgaggccgaccgc   364   FRAGMENT OF SEQ ID NO: 10  (recoded)
       1023   |||||  |||||||   ||      ||    ||   ||  ||    ||||||    ||  ||||||    1092  FRAGMENT OF SEQ ID NO: 205 (recoded)
78.6%    633  catcgccccaaggacatggtgatggtgagcatcatgcccgcacccgcagcaggccgaccgc          702   FRAGMENT OF SEQ ID NO: 219 (recoded)
nucleotide         |    |  |  | | |  |   |  |  |     || |   |    |  | |  |           
identity  212  I   A   P   K   D   M   V   M   V   S   I   M   P   C   T   R   K   Q   S   E   A   D   R   234   FRAGMENT OF SEQ ID NO: 24

I   D   P   K   K   V   F   T   V   T   V   M   P   C   T   S   K   K   F   E   A   D   R
        342   catcgacccaagaaggtgttcaccgtgaccgtgatgcctgcaccagcaagaagttcgaggccgaccgc   364   FRAGMENT OF SEQ ID NO: 10  (wild-type)
       1023   |  |||  ||    ||  || ||  ||||  ||    ||   |||||||   ||   |||  ||      1092  FRAGMENT OF SEQ ID NO: 98  (wild-type)
52.9%    633  tatagatcctaaaaagtattacagtaactgtaatgcctgtacttctaaaaattcgagctgataga       702   FRAGMENT OF SEQ ID NO: 112 (wild-type)
nucleotide       ||  ||   |  |   |  | |  | |   ||||||  | |||| || || |||    |||||
identity  212  catcgcgccaaaggacatggtcatggtgtccatcatgccctgcacgcgcaagcagtcggaggctgaccgc  234   FRAGMENT OF SEQ ID NO: 24
               I   A   P   K   D   M   V   M   V   S   I   M   P   C   T   R   K   Q   S   E   A   D   R V   R   G   L   A   G   I   K   E
              448       gtgcgcggcctggcctggcgccggcatcaaggag           456   FRAGMENT OF SEQ ID NO: 10  (recoded)
             1342       |||||||||| |||||| ||||||||||||||||          1368  FRAGMENT OF SEQ ID NO: 205 (recoded)
92.6%         961       gtgcgcggcatggacggcatggacggcatcaaggag        987   FRAGMENT OF SEQ ID NO: 219 (recoded)
nucleotide              ||||||||| |  ||||| |||||||||||| 
identity      321       V   R   G   M   D   G   I   K   E            329   FRAGMENT OF SEQ ID NO: 24

V   R   G   L   A   G   I   K   E
              448       gtgcgcggcctggcctggcgccggcatcaaggag           456   FRAGMENT OF SEQ ID NO: 10  (wild-type)
             1342       |||   |  |    | ||  |||  |||||| ||          1368  FRAGMENT OF SEQ ID NO: 98  (wild-type)
55.5%         961       gttagaggattagctggaataaaagaa                  987   FRAGMENT OF SEQ ID NO: 112 (wild-type)
nucleotide              |||||||||| |  ||||| ||||||||||| 
identity      321       gtgcgcggcatggacggcatcaaggag                  329   FRAGMENT OF SEQ ID NO: 24
                        V   R   G   M   D   G   I   K   E
```

Most highly conserved amino acids in Fe-hydrogenases are shown in bold (see Happe et. al, Eur J Biochem (2002) Feb;269(3):1022-32).

Figure 11

Escherichia coli strain K12 codon usage table: frequency of use per thousand codons. Most preferred codons are shown in bold.

| | | | | | | | | | | | |
|---|---|---|---|---|---|---|---|---|---|---|---|
| TTT | 22.3 | Phe | TCT | 8.5 | Ser | TAT | 16.2 | Tyr | TGT | 5.2 | Cys |
| TTC | 16.6 | Phe | TCC | 8.6 | Ser | TAC | 12.2 | Tyr | TGC | 6.5 | Cys |
| TTA | 13.9 | Leu | TCA | 7.2 | Ser | TAA | 2.0 | STOP | TGA | 0.9 | STOP |
| TTG | 13.7 | Leu | TCG | 8.9 | Ser | TAG | 0.2 | STOP | TGG | 15.2 | Trp |
| | | | | | | | | | | | |
| CTT | 11.0 | Leu | CCT | 7.0 | Pro | CAT | 12.9 | His | CGT | 20.9 | Arg |
| CTC | 11.1 | Leu | CCC | 5.5 | Pro | CAC | 9.7 | His | CGC | 22.0 | Arg |
| CTA | 3.9 | Leu | CCA | 8.4 | Pro | CAA | 15.3 | Gln | CGA | 3.6 | Arg |
| CTG | 52.6 | Leu | CCG | 23.2 | Pro | CAG | 28.8 | Gln | CGG | 5.4 | Arg |
| | | | | | | | | | | | |
| ATT | 30.3 | Ile | ACT | 9.0 | Thr | AAT | 17.7 | Asn | AGT | 8.8 | Ser |
| ATC | 25.1 | Ile | ACC | 23.4 | Thr | AAC | 21.7 | Asn | AGC | 16.1 | Ser |
| ATA | 4.4 | Ile | ACA | 7.1 | Thr | AAA | 33.6 | Lys | AGA | 2.1 | Arg |
| ATG | 27.9 | Met | ACG | 14.4 | Thr | AAG | 10.3 | Lys | AGG | 1.2 | Arg |
| | | | | | | | | | | | |
| GTT | 18.3 | Val | GCT | 15.3 | Ala | GAT | 32.1 | Asp | GGT | 24.7 | Gly |
| GTC | 15.3 | Val | GCC | 25.5 | Ala | GAC | 19.1 | Asp | GGC | 29.6 | Gly |
| GTA | 10.9 | Val | GCA | 20.1 | Ala | GAA | 39.4 | Glu | GGA | 8.0 | Gly |
| GTG | 26.4 | Val | GCG | 33.6 | Ala | GAG | 17.8 | Glu | GGG | 11.1 | Gly |

Figure 12

Rhodospirillum rubrum codon usage table: frequency of use per thousand codons. Most preferred codons are shown in bold.

| | | | | | | | |
|---|---|---|---|---|---|---|---|
| TTT | 6.5 Phe | TCT | 1.8 Ser | TAT | 14.0 Tyr | TGT | 2.3 Cys |
| TTC | 32.7 Phe | TCC | 10.1 Ser | TAC | 9.9 Tyr | TGC | 9.8 Cys |
| TTA | 0.4 Leu | TCA | 1.0 Ser | TAA | 1.3 STOP | TGA | 1.2 STOP |
| TTG | 11.1 Leu | TCG | 21.6 Ser | TAG | 0.6 STOP | TGG | 12.7 Trp |
| CTT | 11.8 Leu | CCT | 2.8 Pro | CAT | 9.6 His | CGT | 6.6 Arg |
| CTC | 14.9 Leu | CCC | 20.2 Pro | CAC | 12.1 His | CGC | 34.6 Arg |
| CTA | 1.2 Leu | CCA | 1.7 Pro | CAA | 5.5 Gln | CGA | 2.4 Arg |
| CTG | 58.7 Leu | CCG | 26.3 Pro | CAG | 23.1 Gln | CGG | 13.7 Arg |
| ATT | 5.8 Ile | ACT | 0.9 Thr | AAT | 7.7 Asn | AGT | 1.5 Ser |
| ATC | 48.0 Ile | ACC | 38.5 Thr | AAC | 16.5 Asn | AGC | 14.9 Ser |
| ATA | 0.5 Ile | ACA | 0.8 Thr | AAA | 5.3 Lys | AGA | 0.4 Arg |
| ATG | 28.3 Met | ACG | 11.9 Thr | AAG | 30.8 Lys | AGG | 1.4 Arg |
| GTT | 10.9 Val | GCT | 7.2 Ala | GAT | 22.5 Asp | GGT | 11.9 Gly |
| GTC | 37.5 Val | GCC | 88.2 Ala | GAC | 29.2 Asp | GGC | 62.4 Gly |
| GTA | 1.0 Val | GCA | 1.6 Ala | GAA | 22.3 Glu | GGA | 5.0 Gly |
| GTG | 30.2 Val | GCG | 30.8 Ala | GAG | 29.5 Glu | GGG | 14.3 Gly |

Pyrococcus furiosus codon usage table: frequency of use per thousand codons. Most preferred codons are shown in bold.

| | | | | | | | |
|---|---|---|---|---|---|---|---|
| TTT | 22.7 Phe | TCT | 6.6 Ser | TAT | 20.8 Tyr | TGT | 4.9 Cys |
| TTC | 18.8 Phe | TCC | 5.2 Ser | TAC | 23.1 Tyr | TGC | 2.4 Cys |
| TTA | 14.4 Leu | TCA | 8.7 Ser | TAA | 0.7 STOP | TGA | 1.5 STOP |
| TTG | 12.4 Leu | TCG | 1.8 Ser | TAG | 0.5 STOP | TGG | 15.3 Trp |
| CTT | 22.3 Leu | CCT | 10.5 Pro | CAT | 7.1 His | CGT | 0.9 Arg |
| CTC | 17.0 Leu | CCC | 8.5 Pro | CAC | 9.9 His | CGC | 0.9 Arg |
| CTA | 15.8 Leu | CCA | 23.3 Pro | CAA | 10.3 Gln | CGA | 0.8 Arg |
| CTG | 7.3 Leu | CCG | 3.5 Pro | CAG | 9.5 Gln | CGG | 0.4 Arg |
| ATT | 28.7 Ile | ACT | 13.8 Thr | AAT | 15.3 Asn | AGT | 10.3 Ser |
| ATC | 12.6 Ile | ACC | 8.0 Thr | AAC | 18.7 Asn | AGC | 11.5 Ser |
| ATA | 35.1 Ile | ACA | 15.9 Thr | AAA | 31.8 Lys | AGA | 27.5 Arg |
| ATG | 22.0 Met | ACG | 5.2 Thr | AAG | 48.7 Lys | AGG | 21.3 Arg |
| GTT | 36.5 Val | GCT | 23.1 Ala | GAT | 29.9 Asp | GGT | 16.1 Gly |
| GTC | 11.0 Val | GCC | 14.3 Ala | GAC | 20.0 Asp | GGC | 8.5 Gly |
| GTA | 16.9 Val | GCA | 27.8 Ala | GAA | 48.5 Glu | GGA | 37.5 Gly |
| GTG | 13.2 Val | GCG | 5.4 Ala | GAG | 45.3 Glu | GGG | 11.6 Gly |

NiFe-hydrogenase Recoding Key

E. Coli strain K12 Codon Usage Table: most preferred codons are shown underlined and in bold-face type

| | | | | | | | |
|---|---|---|---|---|---|---|---|
| TTT 22.3 Phe | TCT 8.5 Ser | TAT 16.2 Tyr | TGT 5.2 Cys |
| TTC 16.6 Phe | TCC 8.6 Ser | TAC 12.2 Tyr | TGC 6.5 Cys |
| TTA 13.9 Leu | TCA 7.2 Ser | TAA 2.0 STOP | TGA 0.9 STOP |
| TTG 13.7 Leu | TCG 8.9 Ser | TAG 0.2 STOP | TGG 15.2 Trp |
| | | | |
| CTT 11.0 Leu | CCT 7.0 Pro | CAT 12.9 His | CGT 20.9 Arg |
| CTC 11.1 Leu | CCC 5.5 Pro | CAC 9.7 His | CGC 22.0 Arg |
| CTA 3.9 Leu | CCA 8.4 Pro | CAA 15.3 Gln | CGA 3.6 Arg |
| CTG 52.6 Leu | CCG 23.2 Pro | CAG 28.8 Gln | CGG 5.4 Arg |
| | | | |
| ATT 30.3 Ile | ACT 9.0 Thr | AAT 17.7 Asn | AGT 8.8 Ser |
| ATC 25.1 Ile | ACC 23.4 Thr | AAC 21.7 Asn | AGC 16.1 Ser |
| ATA 4.4 Ile | ACA 7.1 Thr | AAA 33.6 Lys | AGA 2.1 Arg |
| ATG 27.9 Met | ACG 14.4 Thr | AAG 10.3 Lys | AGG 1.2 Arg |
| | | | |
| GTT 18.3 Val | GCT 15.3 Ala | GAT 32.1 Asp | GGT 24.7 Gly |
| GTC 15.3 Val | GCC 25.5 Ala | GAC 19.1 Asp | GGC 29.6 Gly |
| GTA 10.9 Val | GCA 20.1 Ala | GAA 39.4 Glu | GGA 8.0 Gly |
| GTG 26.4 Val | GCG 33.6 Ala | GAG 17.8 Glu | GGG 11.1 Gly |

Codons used to recode SEQ ID NOS: to obtain SEQ ID NOS:

| | | | | |
|---|---|---|---|---|
| A-Ala gcg | N-Asn aac | D-Asp gat | C-Cys tgc | Q-Gln cag |
| E-Glu gaa | H-His cat | I-Ile att | L-Leu ctg | K-Lys aaa |
| M-Met atg | P-Pro ccg | S-Ser agc | Stop taa | T-Thr acc |
| W-Trp tgg | Y-Tyr tat | V-Val gtg | | |

Wild type Entamoeba histolytica Fe-hydrogenase (GenBank Accession Number AF248542; SEQ ID NO: 91)

atg cca cct aaa cca tca cat aca ctc acc gga cat gac cat aac cat agt att caa ttt gat tgg tct aaa tgc atg ggt tgt gga atg tgt gct act aaa tgt act ttt
ggg gtg tta gta aaa caa cca cca aaa att cca cca ttt gtt cag cct aat aga gaa aaa ctc tct caa gaa aat acc gac aag aca aga gta ctt att gat gag tct
gaa tgt act ggg tgt ggt caa tgt tct ttg gtt tgt aac ttt ggt tct att aca cca ata gac cat ctt gtt gat act ttt aaa gct aaa gaa gct gga aag aag ctt gtt gct atg
att gca cct tca act cgt tta ggt gtt gct gag gct atg gga atg cct att gga agt aca gct atg gct cag tta gtt cat tgt tta aga ctt att gga ttt gat tat gta ttt gat
gtt gat gct gga gct gat aag aca aca atg gat gat tat gcc gaa gtt att gaa atg aaa aaa gaa gga aaa gga cct gct att act tcc tgt tgt cct gct tgg att gaa
ctt gtt gaa aaa gaa tat cct gac tta att cca aac gtc tct act gcc cgt tca cca att gga tgt tta gct ggt tgt att aaa aga gga tgg gca aag gat gta gga att gca
gta gaa gat ctt tac act gtt gga ata atg cct tgt att gct aaa aaa aca gag tct caa aga caa caa att cat caa gac tat gat gct tca tgt act tca aat gaa att gct gct
tat ttc aaa aaa cat ctt cca cct gaa gaa tgt aaa ttt aca caa gaa aga gaa gaa gca ctt gct aaa act gaa gat ggt caa tgt gat tta cca ttt aga cgt att tct ggt ggt tct
aat att ttt gga aag act gga gga gtt tgt gaa act gta ttg aga gta att gca cgt aat gca gga gtt gat tgg aac agt tgt act gtt aac aag gaa gaa act ttt aaa cat
gct gca agt gga tca aca atg aca aat ctt tct gtt gat att ggt gga act att atc aca ggt gct gtt tgt cat ggt ggt tat gct att aga cat gct tgt gaa ctt att aga aaa gga
gag tta aaa gtt gat gtt gtt gaa atg atg gca tgt gtt gga ggt tgt ctt gga gga gca ggt caa cca aaa att cca cca gca aag aaa ctt gag atg gat aag aga
aga gta atg tta gat att tta gat caa caa act gat att aga gct gct aat gaa aat act gat gtt ctt gga tgg att gat aaa cat ttt gat cat caa ggt gca cat cag cat ctt
cac aca tat ttt act ccc aga tat caa aac taa Codons most preferred in C. Reinhardtii are shown in large font
Codons not most preferred in C. Reinhardtii are shown in small font

Figure 15

Entamoeba histolytica Fe-hydrogenase Recoded to single C. reinhardtii preferred codons (SEQ ID NO: 198)

atg ccc ccc aag ccc agc cac acc ctg acc ggc cac gac cac aac cac agc atc cag ttc gac tgg agc aag
tgc atg ggc tgc ggc atg tgc gcc acc aag tgc acc ttc ggc gtg ctg gtg aag cag ccc ccc aag atc ccc
ccc ttc gtg cag ccc aac cgc gag aag ctg agc cag gag aac acc gac aag acc cgc gtg ctg atc gac
gag agc gag tgc acc ggc tgc ggc cag tgc agc ctg gtg tgc aac ttc ggc agc atc acc ccc atc gac cac
ctg gtg gac acc ttc aag gcc aag gag gcc ggc aag aag ctg gtg gcc atg atc gcc ccc agc acc cgc ctg
ggc gtg gcc gag gcc atg ggc atg ccc atc ggc agc acc gcc atg gcc cag ctg gtg cac tgc ctg cgc ctg
atc ggc ttc gac tac gtg ttc gac gtg gac gcc ggc gcc gac aag acc acc atg gac gac tac gcc gag gtg
atc gag atg aag aag gag ggc aag ggc ccc gcc atc acc agc tgc tgc ccc gcc tgg atc gag ctg gtg
gag aag gag tac ccc gac ctg atc ccc aac gtg agc acc gcc cgc agc ccc atc ggc tgc ctg gcc ggc tgc
atc aag cgc ggc tgg gcc aag gac gtg ggc atc gcc gtg gag gac ctg tac acc gtg ggc atc atg ccc tgc
atc gcc aag aag acc gag agc cag cgc cag cag atc cac cag gac tac gac gcc agc tgc acc agc aac
gag atc gcc gcc tac ttc aag aag cac ctg ccc ccc gag gag tgc aag ttc acc cag gag cgc gag gag gcc
ctg gcc aag acc gag gac ggc cag tgc gac ctg ccc ttc cgc cgc atc agc ggc ggc agc aac atc ttc ggc
aag acc ggc ggc gtg tgc gag acc gtg ctg cgc gtg atc gcc cgc aac gcc ggc gtg gac tgg aac agc
tgc acc gtg aac aag gag gag acc ttc aag cac gcc gcc agc ggc agc acc atg acc aac ctg agc gtg
gac atc ggc ggc acc atc atc acc ggc gcc gtg tgc cac ggc ggc tac gcc atc cgc cac gcc tgc gag ctg
atc cgc aag ggc gag ctg aag gtg gac gtg gtg gag atg atg gcc tgc gtg ggc ggc tgc ctg ggc ggc
gcc ggc cag ccc aag atc ccc ccc gcc aag aag ctg gag atg gac aag cgc cgc gtg atg ctg gac atc ctg
gac cag cag acc gac atc cgc gcc gcc aac gag aac acc gac gtg ctg ggc tgg atc gac aag cac ttc
gac cac cag ggc gcc cac cag cac ctg cac acc tac ttc acc ccc cgc tac cag aac taa All codons are most preferred codons in C. reinhardtii and conform to Figure 4

Figure 16

Basic Genetic Code

| | | | |
|---|---|---|---|
| TTT Phe | TCT Ser | TAT Tyr | TGT Cys |
| TTC Phe | TCC Ser | TAC Tyr | TGC Cys |
| TTA Leu | TCA Ser | TAA STOP | TGA STOP |
| TTG Leu | TCG Ser | TAG STOP | TGG Trp |
| CTT Leu | CCT Pro | CAT His | CGT Arg |
| CTC Leu | CCC Pro | CAC His | CGC Arg |
| CTA Leu | CCA Pro | CAA Gln | CGA Arg |
| CTG Leu | CCG Pro | CAG Gln | CGG Arg |
| ATT Ile | ACT Thr | AAT Asn | AGT Ser |
| ATC Ile | ACC Thr | AAC Asn | AGC Ser |
| ATA Ile | ACA Thr | AAA Lys | AGA Arg |
| ATG Met | ACG Thr | AAG Lys | AGG Arg |
| GTT Val | GCT Ala | GAT Asp | GGT Gly |
| GTC Val | GCC Ala | GAC Asp | GGC Gly |
| GTA Val | GCA Ala | GAA Glu | GGA Gly |
| GTG Val | GCG Ala | GAG Glu | GGG Gly |

METHODS AND COMPOSITIONS FOR EVOLVING HYDROGENASE GENES

BACKGROUND OF THE INVENTION

Evolving genes through directed evolution procedures is a way of generating novel nucleic acids sequences that encode proteins that can perform desired functions quickly and efficiently. One method of directed evolution is error-prone PCR, in which a DNA Polymerase incorporates random single-base sequence errors into a product. (Leung et al., Technique (1989) 1, 11–15) Another technique is site directed mutagenesis, in which one or more particular amino acids in a gene are substituted for a different amino acid. Other methods utilize agents that induce random mutation, such as the addition of compounds such as nitrosoguanidine (NTG) to the culture media of a population of organisms (for example, see Nestmann E R Mutat Res 1975 June;28(3): 323–30). The resulting nucleic acid sequences and genomic sequences created using these procedures comprise a library of sequences with differing abilities to perform a desired function, and the performance of that function is then assayed for and novel and desirable sequences are identified.

Assay procedures for desired functions may be employed to test the aforementioned nucleic acid sequences for a desired function. For instance, an enzyme that functions best at pH 5.0 may be mutagenized and the resulting population of sequences is then assayed for the production of the product of the enzymatic reaction at pH 7.0. Alternatively, sequences encoding antibodies may be mutagenized and then assayed for the ability to bind a particular molecule with an affinity that is stronger or weaker than the original antibody sequence.

The assay system for directed evolution procedures may be based on selection or screening, or both. In a typical selection protocol, organisms that are transformed with or contain mutagenized sequences are put through a procedure in which the ability to perform a given function is coupled with the ability to survive the conditions that the transformed organisms are subjected to. For instance, an enzyme that has potential bioremediation functions may be mutagenized and an organism is transformed with the library. Organisms that can detoxify a toxic compound using a mutagenized enzyme under conditions in which the toxic compound is supplied at a concentration that would otherwise kill the organism are selected for. In screening procedures, organisms that cannot perform the desired function survive, but do not identify mutagenized versions of genes that are desirable. For instance, an enzyme that cleaves a substrate that exhibits a first fluorescence emission wavelength spectrum when intact and a measurably distinct second fluorescence emission wavelength spectrum after catalysis may be screened for when the transformed organisms are subjected to specific fluorescent excitation wavelengths of light and the emission is monitored at two or more wavelengths. Enzymes that cleave the substrate at an enhanced rate may be identified.

Directed evolution is therefore a useful method through which genes may be adapted to perform desirable functions.

BRIEF SUMMARY OF THE INVENTION

The invention provides methods of evolving hydrogenase genes comprising providing at least two distinct hydrogenase coding sequences or fragments thereof, wherein at least one of said coding sequences or fragments thereof has been modified from its wild-type sequence by at least one nucleotide to more closely adhere to codon usage preferences of an organism, followed by performing an annealing-based recombination reaction with the at least two distinct hydrogenase coding sequences or fragments thereof to generate a recoded and recombined hydrogenase library, followed expressing the recoded and recombined hydrogenase library in the organism, and screening or selecting for a transformed organism that exhibits a desired phenotype.

The invention further provides methods wherein the hydrogenase coding sequences are Fe-hydrogenase or NiFe-hydrogenase genes or fragments thereof.

The invention further provides methods wherein the organism is capable of performing photosynthesis, and further wherein the organism is a green algae species. The invention further provides methods wherein the organism is from the genus *Chlamydomonas*, and further wherein the organism is *Chlamydomonas reinhardtii*. The invention also provides methods wherein the organism is prokaryotic, and further wherein the organism is *E. coli*. The invention also provides methods wherein the organism is a cyanobacteria or a photosynthetic bacteria.

The invention provides Fe-hydrogenase and NiFe-hydrogenase coding sequences that have been recoded to utilize only the most preferred codons in *Chlamydomonas reinhardtii* and *E. coli* strain K12, respectively. The invention also provides methods of recombining the recoded hydrogenase coding sequences using an annealing-based recombination reaction.

The invention further comprises methods of performing annealing-based recombination reactions that include variant oligonucleotides that do not correspond to any known naturally occurring hydrogenase genes, but contain hydrogenase sequences that are substituted at one or more amino acids. The invention also provides methods of performing saturation mutagenesis on recoded hydrogenase genes, preferably at amino acid positions in and near the active site of hydrogenases.

The invention provides methods of screening or selecting recoded and recombined hydrogenase sequences for phenotypes such as Oxygen tolerance, the increased ability to accept electrons from ferredoxin, the ability to catalyze the formation of molecular Hydrogen in the presence of molecules such as metronidazole, and the ability to catalyze the formation of molecular Hydrogen at increased rates over wild-type hydrogenases.

The invention further provides methods of selecting organisms for desirable hydrogenase phenotypes wherein the organism that is transformed with a recoded and recombined hydrogenase sequences is also transformed with mutagenized and/or upregulated nucleic acid sequences that encode proteins that are involved in electron transfer to a hydrogenase protein, such as ferredoxin, psaA, psaB, psaC, psaD, psaE, psaF, psaL, psaX and components of the cytochrome $b_6f$ complex.

The invention further provides methods of selecting organisms for desirable hydrogenase phenotypes wherein the organism that is transformed with a recoded and recombined hydrogenase sequence is also transformed with at least one nucleic acid sequence, besides hydrogenase, that is upregulated in response to Sulfur deprivation in green algae but is regulated by a different promoter sequences than its naturally occurring promoter sequence, such as a constitutive or light-regulated promoter.

The invention further provides methods of mating strains of organisms that contain recoded and recombined hydrogenase sequences that catalyze the formation of molecular Hydrogen at an enhanced level over naturally occurring hydrogenase sequences with strains of the same organism that contain genetic modifications such as random integration of transposons or other nucleic acid sequences, expression of RNAi constructs that are driven by light-inducible or dark-inducible promoters, and genomic backgrounds that have been randomly mutagenized using mutagenesis agents such as chemicals or UV light.

BRIEF DESCRIPTION OF THE DRAWINGS

FIG. 1 illustrates codon usage tables for the organisms *Chlamydomonas reinhardtii* and *Clostridium perfringens*. The numbers next to each codon are the frequency of the use of that codon per thousand codons in transcribed and translated sequences from the genomes of each respective organism. The most preferred codon for each amino acid and stop codon is depicted in bold font.

FIG. 2 illustrates codon usage tables for the organism *Entamoeba histolytica* The numbers next to each codon are the frequency of the use of that codon per thousand codons in transcribed and translated sequences from the genome the organism. The most preferred codon for each amino acid and stop codon is depicted in bold font.

FIG. 3 illustrates how one type of annealing-based recombination method, known as DNA shuffling, recombines sequences from different genes to create a library of recombined sequences encoding variants of the starting gene sequences. FIG. 3 is schematic and generally depicts methods of DNA shuffling that can be found in patents such as U.S. Pat. Nos. 5,830,721, 5,605,793, 6,132,970, and 6,180,406.

FIG. 4 illustrates the recoding sequence key for recoding Fe-hydrogenase genes. The nucleotide sequences set forth in SEQ ID NOs: 88–174 were recoded to utilize only the most preferred codons in *C. reinhardtii*, as shown in bold and underlined font, to generate the nucleotide sequences set forth in SEQ ID NOs: 195–281. SEQ ID NOs: 88–174 and 195–281 encode the amino acid sequences set forth in SEQ ID NOs: 1–87.

FIG. 6 illustrates naturally occurring iterations of the Fe-hydrogenase FXXXGGVMEAAXR (SEQ ID NO: 347) amino acid motif.

FIG. 7 illustrates all possible iterations of the Fe-hydrogenase FXXXGGVMEAAXR (SEQ ID NO: 347) motif containing naturally occurring amino acids found in SEQ ID NOs: 1–87 at variable positions. 120 possible amino acid sequences conform to the key. Of these 120 possible sequences, only 12 naturally occur in known Fe-hydrogenase sequences.

FIG. 8 illustrates engineered iterations of the FXXXG-GVMEAAXR (SEQ ID NO: 347) motif that do not naturally occur in known Fe-hydrogenase genes. Variant oligonucleotides corresponding to each amino acid sequence that utilize *C. reinhardtii* preferred codons specified in FIG. 4 are depicted beside each amino acid sequence.

FIG. 9 illustrates the experimental results of BLAST comparisons of the wild-type and recoded *Chlamydomonas reinhardtii* and *Clostridium perfringens* Fe-hydrogenase genes. Some sections of the genes that encoded conserved amino acids in Fe-hydrogenases are illustrated. The increase in percent nucleotide identity between the wild-type and recoded sequences is listed at left. Annealing-based recombination methods generally require at least 60% nucleotide identity between two sequences for sequence-specific annealing to occur in the absence of non-sequence-specific annealing. The invention creates hydrogenase gene sequences that are recombined using any annealing-based recombination method, wherein the corresponding wild-type gene sequences cannot be recombined or as effectively recombined in annealing-based recombination methods. Top nucleotide strand of each recoded sequence comparison is recoded *Clostridium perfringens* Fe-hydrogenase sequence fragment from SEQ ID NO:205, with the corresponding amino acid sequence of the fragment from SEQ ID NO: 10. Bottom strand of each recoded sequence comparison is recoded *Chlamydomonas reinhardtii* Fe-hydrogenase sequence fragment from SEQ ID NO:219, with the corresponding amino acid sequence of the fragment from SEQ ID NO:24. Top nucleotide strand of each wild-type sequence comparison is wild-type *Clostridium perfringens* Fe-hydrogenase sequence fragment from SEQ ID NO:98, with the corresponding amino acid sequence of the fragment from SEQ ID NO:10. Bottom nucleotide strand of each wild-type sequence comparison is wild-type *Chlamydomonas reinhardtii* Fe-hydrogenase sequence fragment from SEQ ID NO:112, with the corresponding amino acid sequence of the fragment from SEQ ID NO:24.

FIG. 10 illustrates the comparison other amino acid motifs in Fe-hydrogenase as described for FIG. 9. Top nucleotide strand of each recoded sequence comparison is recoded *Clostridium perfringens* Fe-hydrogenase sequence fragment from SEQ ID NO:205, with the corresponding amino acid sequence of the fragment from SEQ ID NO:10. Bottom strand of each recoded sequence comparison is recoded *Chlamydomonas reinhardtii* Fe-hydrogenase sequence fragment from SEQ ID NO:219, with the corresponding amino acid sequence of the fragment from SEQ ID NO:24. Top nucleotide strand of each wild-type sequence comparison is wild-type *Clostridium perfringens* Fe-hydrogenase sequence fragment from SEQ ID NO:98, with the corresponding amino acid sequence of the fragment from SEQ ID NO:10. Bottom nucleotide strand of each wild-type sequence comparison is wild-type *Chlamydomonas reinhardtii* Fe-hydrogenase sequence fragment from SEQ ID NO:112, with the corresponding amino acid sequence of the fragment from SEQ ID NO:24.

FIG. 11 illustrates codon usage tables for the organism *Escherichia coli* strain K12. The numbers next to each codon are the frequency of the use of that codon per thousand codons in transcribed and translated sequences from the genome of the organism. The most preferred codon for each amino acid and stop codon is depicted in bold font.

FIG. 12 illustrates codon usage tables for the organisms *Pyrococcus furiosus* and *Rhodospirillum rubrumcodon*. The numbers next to each codon are the frequency of the use of that codon per thousand codons in transcribed and translated sequences from the genomes of each respective organism. The most preferred codon for each amino acid and stop codon is depicted in bold font.

FIG. 13 illustrates the recoding sequence key for recoding NiFe-hydrogenase genes. The nucleotide sequences set forth in SEQ ID NOs: 184–194 were recoded to utilize only the most preferred codons in *Chlamydomonas reinhardtii*, as shown in bold and underlined font, to generate the nucleotide sequences set forth in SEQ ID NOs: 330–339. SEQ ID NOs: 184–194 and 330–339 encode the amino acid sequences set forth in SEQ ID NOs: 1–87.

FIG. 14 illustrates the wild-type *Entamoeba histolytica* Fe-hydrogenase (GenBank Accession Number AF248542; SEQ ID NO: 91). Codons most preferred in *Chlamydomonas reinhardtii* are shown in large font. Codons not most preferred in *Chlamydomonas reinhardtii* are shown in small font.

FIG. 15 illustrates *Entamoeba histolytica* Fe-hydrogenase recoded to single *Chlamydomonas reinhardtii* preferred codons (SEQ ID NO: 198). The gene sequences is recoded according to FIG. 4.

FIG. 16 illustrates the standard genetic code.

DETAILED DESCRIPTION OF THE INVENTION

Figure 5:
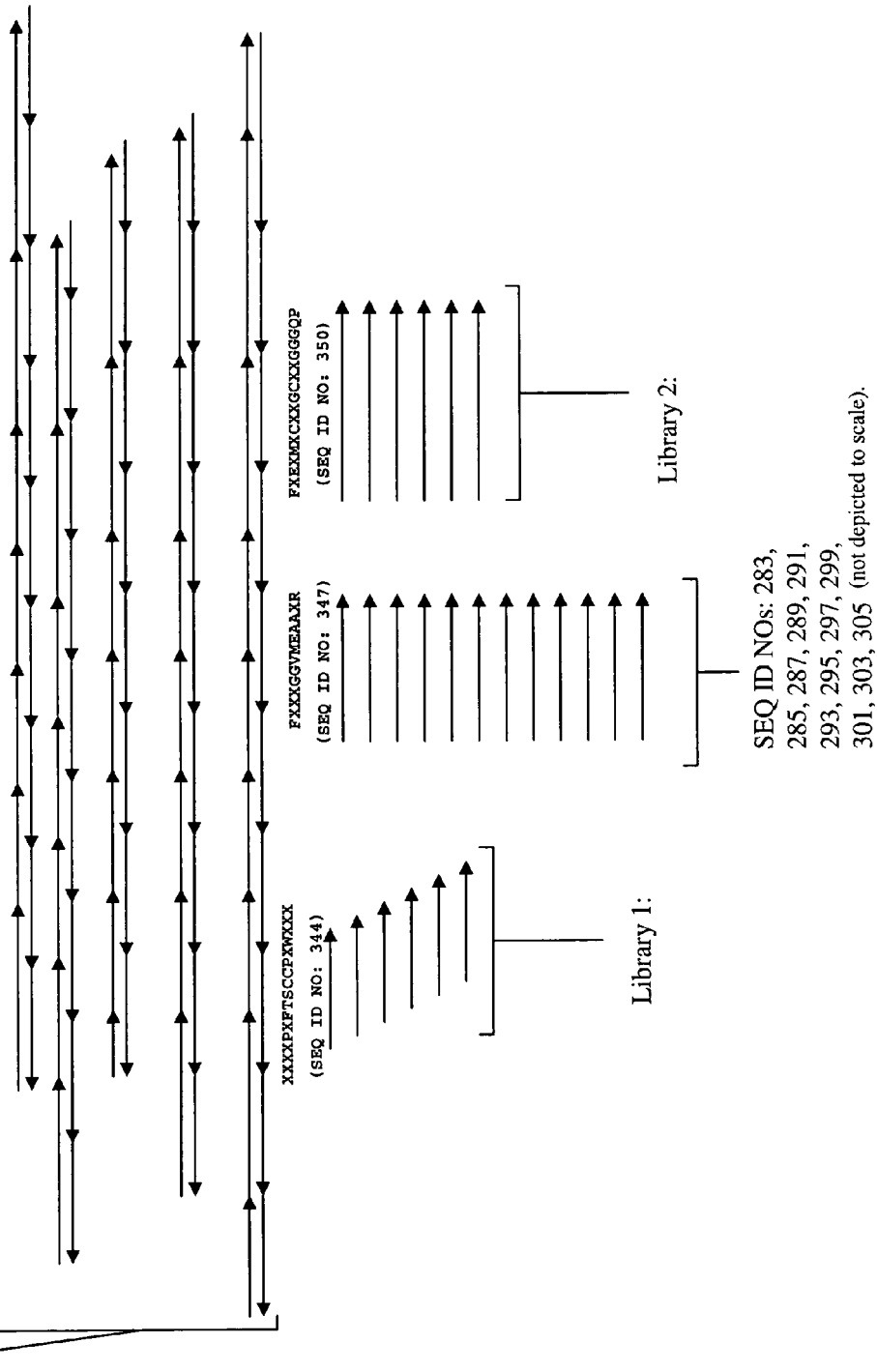
FIG. 5 illustrates an embodiment of the invention in which oligonucleotides that correspond to fragments of recoded gene sequences are designed to cover all regions of the recoded sequences. Each arrow depicts a region of a gene that the oligonucleotide corresponds in sequence to. The oligonucleotides are then subjected to an annealing-based recombination method. Library 1 and Library 2 depict other oligonucleotide sequences that correspond to variants of the conserved PXFTSCCPXW (SEQ ID NO: 345) and FXEXMXCXXGCXXGGGQP (SEQ ID NO: 350) amino acid motifs of Fe-hydrogenase proteins. Arrows point in the 5'→3' direction.
Figure 17:
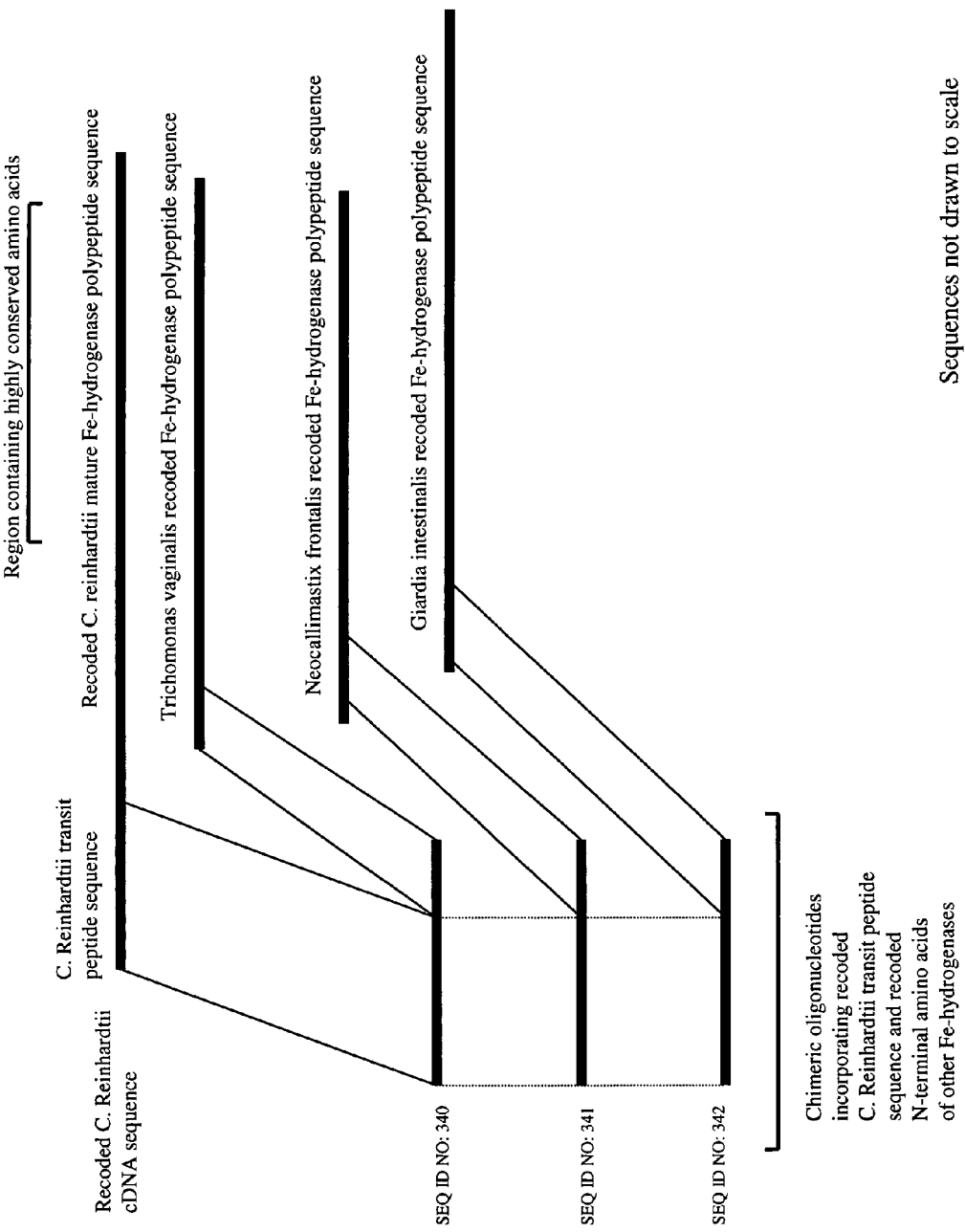
FIG. 17 illustrates the design of chimeric oligonucleotide sequences that encode the *C. reinhardtii* hydrogenase transit peptide and N-terminal segments of other recoded Fe-hydrogenase proteins. Inclusion of these chimeric oligonucleotides in an annealing-based recombination reaction ensures that hydrogenase proteins encoded by the recoded and recombined Fe-hydrogenase library is targeted to the chloroplast stroma when the library is expressed in *C. reinhardtii* as a host organism. The *C. reinhardtii* Fe-hydrogenase gene is nuclear encoded, and in one embodiment the recoded and recombined Fe-hydrogenase library is used to transform *C. reinhardtii* using methods that target the nuclear genome.

U.S. patent application Ser. No. 10/287,750, entitled "Methods and compositions for generating microbes capable of producing large amounts of hydrogen", as well as all other references cited, are hereby incorporated by reference for all purposes.

DEFINITIONS

The following definitions are intended to convey the intended meaning of terms used throughout the specification and claims, however they are not limiting in the sense that minor or trivial differences fall within their scope.

The term "preferred codon" means a triplet nucleotide sequence that encodes an amino acid that is utilized in the coding sequences of an organism at a higher frequency than another triplet nucleotide sequence that encodes the same amino acid.

The term "most preferred codons" means a triplet nucleotide sequence that encodes an amino acid that are utilized in the coding sequences of an organism at a higher frequency than all other triplet nucleotide sequences that encode the same amino acid.

The term "recoding" refers to the process of altering the naturally occurring coding sequence of a gene such that at least one codon is changed in nucleotide sequence by at least one nucleotide but still encodes the same amino acid sequence, wherein the a new codon is utilized by an organism in a higher frequency than the naturally occurring codon at that position. In one embodiment all codons in a coding sequence that are not the most preferred codon for each amino acid are recoded to contain the most preferred codons for each amino acid for an organism. Genes from the organism and from other organisms may be recoded to conform to the most preferred codons of the organism.

The term "recoded and recombined hydrogenase library" refers to a population of nucleotide sequences that have been created through the recoding of at least one hydrogenase nucleotide sequence followed by the inclusion of the recoded at least one hydrogenase nucleotide sequence with another distinct hydrogenase nucleotide sequence of the same class in an annealing-based recombination reaction Classes of hydrogenases are Fe-hydrogenases, NiFe-hydrogenases, and metal-free hydrogenases.

The term "annealing-based recombination reaction" or "annealing-based recombination method" refers to procedures of recombining distinct gene sequences that possess sequence homology to each other by allowing single-stranded nucleic acid molecules of the distinct gene sequences that are complementary or partially complementary to anneal to each other, followed by the addition of a DNA polymerase enzyme, to generate novel nucleic acid sequences.

The term "DNA shuffling" refers to annealing-based recombination methods wherein fragments of gene sequences are allowed to anneal and recombine, as illustrated in FIG. 3 and as disclosed, for example, in U.S. Pat. Nos. 5,605,793, 6,132,970, and 6,180,406.

The term "exonuclease-mediated recombination methods" refers to annealing-based recombination methods wherein a poly-binding nucleic acid molecule is annealed to two or more mono-binding nucleic acid molecules, as defined and as disclosed, for example, in U.S. Pat. No. 6,361,974.

The term "saturation mutagenesis" refers to the generation of a library of nucleotide sequences wherein all 20 naturally occurring amino acids are substituted in the same amino acid position in each of 20 nucleotide sequences, as defined and set forth in U.S. Pat. No. 6,361,974.

The term "codon usage regime" refers to the codon usage preferences of a particular organism, such as the codon usage regimes depicted in FIGS. 1, 2, 4, 11, 12, and 13.

The term "variant oligonucleotides" refers to oligonucleotides that encode a sequence corresponding to a segment of a hydrogenase gene that differs by at least one amino acid from known wild-type amino acid sequences of hydrogenase proteins. The term "variant oligonucleotide library" refers to a population of variant oligonucleotides with distinct sequences. Variant oligonucleotides utilize preferred and preferably most preferred codons of a particular organism.

The term "molecular hydrogen" means two Hydrogen atoms bonded in the chemical formula $H_2$, also referred to as "Hydrogen" herein.

The term "Fe-hydrogenase" refers to an enzyme that catalyzes the formation of molecular Hydrogen and contains at least one Iron atom but no Nickel atoms covalently bonded to amino acids in and near the active site. The term "NiFe-hydrogenase" refers to an enzyme that catalyzes the formation of molecular Hydrogen and contains at least one Iron atom and at least one Nickel atom covalently bonded to amino acids in and near the active site. The term "metal-free hydrogenase" refers to an enzyme that catalyzes the formation of molecular Hydrogen and does not contain metal atoms covalently bonded to amino acids in and near the active site.

The term "Oxygen tolerance" refers to the ability of a hydrogenase protein to catalyze the formation of molecular Hydrogen in the presence of Oxygen. For example, an Fe-hydrogenase that catalyzes the formation of molecular Hydrogen in the presence of 3% Oxygen is an Oxygen tolerant hydrogenase.

The term "*Chlamydomonas reinhardtii*" means *C. reinhardtii*, a species of green algae. Abbreviations of species names such as this are used throughout.

The invention provides methods of directing the evolution of hydrogenase genes to exhibit desired properties such as increased catalytic activity, Oxygen tolerance, the ability to functionally interact with other proteins such as ferredoxins, and other properties. The invention provides compositions with which to perform the process. Novel nucleic acid sequences are provided that impart the to ability to evolve hydrogenase genes. The present invention provides the insight that modifying the sequence of hydrogenase genes using methods disclosed herein allows for the simultaneous benefits of exploration of sequence function that would normally be silent in an activity assay and increased recombination frequency between hydrogenase-encoding nucleic acid sequences.

The methods of the invention work by first altering nucleotides within the coding sequence of at least one hydrogenase gene to conform to a codon usage regime that corresponds to a preferred codon usage regime in a host organism. This is referred to as recoding. The at least one hydrogenase gene and at least one other hydrogenase gene of the same class or fragments thereof are subjected to an annealing-based recombination reaction that depends on single stranded nucleic acid molecules that originate from different parent genes annealing in a sequence-specific fashion to other complementary or partially complementary stranded nucleic acid molecules. One or more of a number of distinct annealing-based recombination methods discussed herein are then performed that allow fragments of hydrogenase genes to be incorporated into novel hydrogenase gene sequences, each novel sequence being a member of a library of recoded and recombined hydrogenase sequences. The library is then expressed in the host organism and at least one phenotype is screened or selected for. For example, the phenotype of increased catalytic activity of a hydrogenase over the parent sequences is screened or selected for. Another example of a phenotype that may be separately or simultaneously screened or selected for is the ability of hydrogenase enzymes encoded in the library to catalyze the formation of Hydrogen in the presence of Oxygen, such as 10% Oxygen.

Sequence function of hydrogenases that would normally be silent in the phenotypic assay is effectively assayed in the methods of the invention. This is because segments of hydrogenase gene sequence that would normally not be expressed in a host organism due to poor translation resulting from differences in codon preferences between the host organism and the organism from which parent hydrogenase sequences are obtained are instead highly expressed due to the recoding of the parent sequences.

Increased recombination also occurs during the annealing-based recombination process when recoded sequences are employed rather than wild-type sequences because parent hydrogenase genes included in the reaction are from an extremely diverse set of organisms that each exhibit unique codon usage regimes. But for the methods of the invention, all of the hydrogenase genes of a given class could not be effectively recombined since many hydrogenase sequences of a given class possess no significant nucleotide sequence homology to each other despite the fact that in regions corresponding to conserved residues they encoded proteins that possess significant amino acid sequence homology. The nucleic acid sequences provided herein were created through the methods of the invention and provide the ability to effectively recombine and assay all known hydrogenase genes and fragments of hydrogenase genes of a given class for desired phenotypes. The invention therefore allows for the exploration of greater amino acid sequence diversity through annealing-based recombination methods, and thus provides the ability to obtain sequences of hydrogenases that possess a greater array of phenotypic characteristics.

Novel hydrogenase genes created using the methods and compositions of the invention are useful for the generation of Hydrogen for use as an energy source. Hydrogen produced by microbes created through the methods of the invention is harvested from culture containers and used as an energy source.

I General Explanations

A. Function of Hydrogenases and Sequence Similarity of Related Hydrogenases

Hydrogenases are enzymes that catalyze the formation or consumption of molecular Hydrogen in the reversible reaction:

$$2H^+ + 2e^- \rightleftharpoons 2H_2$$

Although the reaction can be catalyzed in either direction, most hydrogenases preferentially catalyze the reaction in one direction over the other. The electrons that are utilized in the reaction arrive at the hydrogenase after flowing down the electron transport chain. In photosynthetic electron transport chains, the electrons flow through the cytochrome $b_6f$ and photosystem I complexes through proteins such as psaA, psaB, psaC, psaD, psae, psaF and psaL to ferredoxin before being transferred to the hydrogenase enzyme.

It is an object of the invention to provide hydrogenase sequences that catalyze the formation of molecular Hydrogen at increased rates and in increasing amounts over naturally occurring hydrogenase enzymes. The methods provided herein are directed to the generation of novel hydrogenase genes that are used in the commercial production of Hydrogen.

There are three classes of hydrogenase genes, Fe-hydrogenases (iron-containing), NiFe-hydrogenases (nickel and iron-containing), and metal free hydrogenases. Fe and NiFe hydrogenases are the result of convergent evolution. Though they possess similarly structured active sites, they do not represent different branches of a gene family coming from a common ancestral hydrogenase. Metal free hydrogenases do not contain metal atoms. For a discussion of all three classes see Vignais et al. FEMS Microbiol Rev 2001 August;25(4): 455–501. Different classes of hydrogenases are found in different organisms. For example, many organisms possess Fe-hydrogenase genes, such as *Clostriduim pasteuranum, Desulfovibrio vulgaris, Clostridium perfringens, Megasphaera elsdenii, Chlamydomonas reinhardtii*, and many others. Some organisms such as *Desulfovibrio vulgaris* possess both Fe and NiFe-hydrogenases. The catalytic activity of both Fe and NiFe classes of hydrogenase enzymes is irreversibly or reversibly inhibited by the presence of Oxygen.

Within a class of hydrogenase genes the amino acid sequences of the encoded proteins possess high conservation in regions corresponding to the active site and lower conservation or no conservation in other regions. For instance, within the Fe-hydrogenase class, Fe-hydrogenase genes from different organisms possess certain highly conserved residues or motifs of residues. An example of such a motif is the amino acid sequence GGVMEAA (SEQ ID NO: 348), which occurs in most Fe-hydrogenase proteins. See Happe et al., Eur J Biochem (2002) February;269(3):1022–32. Despite the high degree of conservation of certain amino acids, the nucleotide sequences of many hydrogenase sequences vary substantially. In regions of these genes that encode highly conserved amino acids the sequence identity between any two Fe-hydrogenases can be below 50%. In other words, the degree of nucleotide sequence identity between certain hydrogenase genes is not high even in regions that encode conserved amino acid sequences, and is no higher than the identity between random sequences in regions of the genes that encode nonconserved amino acid sequences and in some instances in regions that encode conserved amino acids. The reason the amino acid sequences of hydrogenase genes can retain high identity between proteins while the nucleotide sequences do not retain high identity is due to the degeneracy of the genetic code and the use of different codon usage regimes between organisms.

B. Genetic Code Degeneracy and Codon Preferences

All amino acids with the exception of tryptophan and methionine can be encoded in a gene sequence by more than one codon. Leucine, arginine, and serine can be encoded by any of six different codons, while amino acids such as valine, glycine, and others can be encoded by any of four different codons. Isoleucine is encoded by three different codons. Other amino acids such as histidine and tyrosine are encoded by two different codons. Identical amino acid sequences can therefore be encoded by different nucleotide sequences. See FIG. 16 in which the standard genetic code is illustrated.

Organisms possess preferences for certain codons over other codons that encode the same amino acid. For example, FIG. 1 illustrates the coding preferences of *Clostridium perfringens* and *Chlamydomonas reinhardtii*. For example, TAT codons, encoding tyrosine (Tyr), are located in the coding region of *Clostridium perfringens* genes 37.6 times per thousand codons. The other codon that specifies Tyr, TAC, is located in the coding region of *Clostridium perfringens* genes 7.1 times per thousand codons. *Chlamydomonas reinhardtii* exhibits different preferences than *Clostridium perfringens*. For example, TAT, encoding Tyr, is located in the coding region of *Chlamydomonas reinhardtii* genes 2.6 times per thousand codons. The other codon that specifies Tyr, TAC, is located in the coding region of *Chlamydomonas reinhardtii* genes 23.8 times per thousand codons.

The codon preferences of *C. reinhardtii* and *C. perfringens* are diametrically opposite from each other. In other words, for amino acids that are encoded by two codons, one codon is preferred in *C. reinhardtii* while the other is preferred in *C. perfringens*. For example, *C. reinhardtii* preferentially utilizes TTC to encode phenylalanine (Phe) while *C. perfringens* preferentially utilizes TTT to encode Phe. For amino acids that are encoded by four codons, wherein two are utilized in substantial frequencies in an organism while the other two are not, *C. reinhardtii* preferentially utilizes two while the other two are preferentially utilized in *C. perfringens*. For example, *C. reinhardtii* preferentially utilizes GTG and GTC to encode valine (Val) while *C. perfringens* preferentially utilizes GTT and GTA to encode Val. The only codon that both organisms prefer where there are different codon options available (in other words not methionine or tryptophan) is TAA for a stop codon. The result of these diametrically opposite coding preferences is that genes that encode evolutionarily related proteins that perform the same function in these two organisms do not necessarily possess significant nucleotide identity. For example, the Fe-hydrogenase genes of *C. reinhardtii* and *C. perfringens* do not possess significant nucleotide identity with each other. Many other Fe-hydrogenase genes do not possess significant nucleotide identity with each other for the same reason. In another example, the *Entamoeba histolytica* Fe-hydrogenase gene does not possess significant nucleotide identity with the Fe-hydrogenase gene of *C. reinhardtii* due again to different codon usage preferences between the organisms. FIGS. 1 and 2 demonstrate that, for example, *C. reinhardtii*, *C. perfringens* and *E. histolytica* each utilize a different preferred codon for isoleucine.

Genes from one organism that are cloned or otherwise transformed into a different host organism are frequently not expressed due to codon differences. Although such genes are transcribed, they are not translated well or not translated at all. Host organisms possess low levels of tRNA molecules corresponding to nonpreferred codons. The result is that a gene that encodes a protein that could impart a particular phenotype in a host organism is instead silent if it contains a significant number of nonpreferred codons. The codon usage regime of *C. reinhardtii* is particularly stringent and as a result many foreign gene sequences cannot be expressed in *C. reinhardtii*. See Rochaix J-D et al. (1998) The Molecular Biology of Chloroplasts and Mitochondria in *Chlamydomonas* (Advances in Photosynthesis, Vol 7), p. 30–31.

C. Annealing-Based Recombination Methods

A number of methods have been developed that allow a set of parental sequences to be recombined with each other based on single-stranded nucleic acids from different parent genes, which correspond to sense and antisense strands of the same approximate region of an encoded protein, to recognize each other and anneal. Annealing-based recombination methods also employ DNA-polymerase-based extension, primed by a 3' nucleic acid fragment end from a sense strand, in which the template is the antisense strand. See FIG. 3 for a schematic illustration of one type of annealing-based recombination method. Complete hydrogenase gene sequences are formed by the extension process, which is followed by a ligation and/or PCR protocol that amplifies newly formed genes and ensures that all phosphodiester backbones of the recombined hydrogenase genes are uninterrupted by nicks.

Genes that do not possess significant sequence similarities do not recombine when they are included together in annealing-based recombination reactions. This is because annealing-based recombination reactions work by allowing single stranded nucleotide sequences that possess certain regions of complementary homology to recognize each other, anneal, and prime the extension of new sequence from the 3' ends of fragments by DNA polymerase. Genes that do not possess significant homology to other genes in an annealing-based recombination methods reaction cannot produce fragments that will anneal to fragments from the other genes.

The invention provides methods of recoding genes to possess higher homology to other genes that perform the same function without altering amino acid sequence. The result is that all hydrogenase sequences that possess significant amino acid similarity are recombined in a single annealing-based recombination reaction. Furthermore, the recoding methods also ensure that all sequences created in a recoded and recombined hydrogenase library are translated in a host organism when all genes included in the annealing-based recombination reaction are recoded to use preferred codons of the host organism. The invention therefore solves two problems of annealing-based recombination of hydrogenase genes, namely lack of nucleotide similarity between hydrogenase genes from different organisms and lack of effective translation of a hydrogenase library that is recombined but possesses nonpreferred codons. The invention provides recoded nucleotide sequences of hydrogenase genes. The invention further provides phenotypic assay systems for selecting novel hydrogenase genes that possess desirable qualities such as Oxygen tolerance, increased catalytic activity, and other traits.

II Recoding of Hydrogenase Genes

Step 1 (a): Recoding of Fe-Hydrogenase Genes

Fe-hydrogenase genes were identified by searching for protein sequences that possess significant amino acid sequence similarity to *C. reinhardtii* Fe-hydrogenase (SEQ ID NO: 24). Sequences were identified using the Basic Local Alignment Search Tool (BLAST) (National Center for Biotechnology Information, www.ncbi.nlm.nih.gov). Parameters for the BLAST search were as follows: the peptide sequence database searched was the nr database (Database: All non-redundant GenBank CDS translations+PDB+SwissProt+PIR+PRF); Matrix: BLOSUM62; Gap Penalties: Existence: 11, Extension: 1. 87 unique protein sequences were identified that possess E values of $4^{e-05}$ or smaller (SEQ ID NOS: 1–87). Some proteins were identified that met the E value criteria but either did not appear to be hydrogenase genes, possessed significant homology to the *C. reinhardtii* Fe-hydrogenase protein but did not contain amino acids critical to the Fe-hydrogenase active site, or were positively identified as having functions other than hydrogenase activity in the BLAST entry (protein sequences corresponding to accession numbers gi:15020824, gi:16754852, gi:13385742, gi:26335839, gi:12851667, gi:22654872, gi:14336719, gi:10438504, gi:18414657, gi:27691020, gi:20807184, gi:4930041 and gi:20807368). Optionally genes encoding these sequences may be included with the other 87 gene sequences described below in annealing-based recombination methods.

Wild-type cDNA sequences corresponding to each of the 87 identified protein sequence were then obtained (SEQ ID NOs: 88–174). All cDNA sequences were recoded to utilize the same codon for each amino acid to generate a recoded Fe-hydrogenase cDNA set (SEQ ID NOs: 195–281). The cDNA sequences of SEQ ID NOs: 195–281 were recoded to utilize only the most preferred codons in *C. reinhardtii*, as illustrated in FIG. 4. As part of the process, two unique *C. reinhardtii* Fe-hydrogenase genes (SEQ ID NOs: 112 and 114) were recoded to the same codons specified in FIG. 4 and are components of the Fe-hydrogenase cDNA set. The initial set of 87 wild-type hydrogenase genes may be recoded to any codon usage regime, such as the regime for *C. pasteeuranuum* or *E. histolytica* as illustrated in FIGS. 1 and 2. In other words, recoding the set of wild type hydrogenase genes to the most preferred *C. reinhardtii* codons is but one of many recoding options provided by the invention.

Step 1(b): Recoding of NiFe-Hydrogenase Genes

NiFe-hydrogenase genes encoding hydrogenases that preferentially catalyze the formation of molecular hydrogen over the consumption of molecular hydrogen in the reversible hydrogenase reaction:

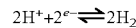

were downloaded and correspond to SEQ ID NOs: 185–194. These cDNA sequences correspond to the small and large subunit genes of the NiFe-hydrogenase catalytic heterodimer. The NiFe-hydrogenase cDNA sequences were recoded to utilize the same codon for each amino acid to generate a recoded small and large subunit NiFe-hydrogenase cDNA set (SEQ ID NOS: 330–339). The cDNA sequences were recoded to utilize only the most preferred codons in *E. coli* strain K12, as illustrated in FIG. 13.

NiFe-hydrogenase enzymes are encoded by two different genes to form catalytically active heterodimers that consist of a small and large subunit. Other NiFe-hydrogenase genes may be recoded using the methods provided, including all NiFe-hydrogenases listed in Table 2 of Vignais et al. FEMS Microbiol Rev 2001 August;25(4):455–501, incorporated by reference in its entirety for all purposes.

Steps 1(a) and 1(b) are alternate protocols for recombining hydrogenases of different classes. Since Fe-hydrogenases and NiFe-hydrogenases are different classes of hydrogenases and do not possess nucleotide or amino acid similarity with each other, only hydrogenase genes of the same class are recoded and put through the annealing-based recombination methods. Furthermore, in the case of NiFe-hydrogenases, small and large subunit genes are recoded and recombined separately followed by coexpression of recoded small and large subunit libraries. In order to practice the invention it is not necessary to recombine and express genes of both classes. Either of the two classes of hydrogenase may be recombined using the methods of the invention. Certain organisms such as *D. vulgaris* possess endogenous hydrogenase genes of both classes and may be used for the expression of recombined genes of both classes.

The examples provided herein demonstrate recoding of Fe-hydrogenase genes encoding proteins of SEQ ID NOs: 1–87 to most preferred *C. reinhardtii* codons, however the invention provides methods of generating gene sequences that encode the amino acid sequences set forth in SEQ ID NOs: 1–87 and utilize preferred or most preferred codons of any host organism. The examples provided herein demonstrate recoding of NiFe-hydrogenase genes encoding proteins of SEQ ID NOs: 175–184 to most preferred *E. coli* strain K12 codons, however the invention provides methods of generating gene sequences that encode the amino acid sequences set forth in SEQ ID NOs: 175–184 and utilize preferred or most preferred codons of any host organism.

III Annealing-Based Recombination of Recoded Hydrogenase Sequences

A. Chemical Synthesis of Parental Recoded Nucleic Acid Sequences

All annealing-based recombination methods of recoded sequences require the synthesis of recoded parental genes or oligonucleotides corresponding to fragments of recoded parental genes. The recoded, synthetic nucleic acids are then subjected to an annealing-based recombination method that allows recoded parental genes or gene fragments to hybridize to other recoded parental genes or gene fragments in a sequence-specific manner, followed by a DNA polymerization step.

Recoded hydrogenase DNA sequences are synthesized by chemical synthesis according to standard methods. For example, synthetic DNA sequences may be purchased from commercial sources such as Operon Technologies, Alameda, Calif. DNA sequences may be synthesized corresponding to the entire length of cDNA sequences, however yields typically decline for synthesis over 100 nucleotides in length. Optionally, oligonucleotides of approximately 30–40 nucleotides in length are synthesized corresponding to the entire sense and antisense sequence of each SEQ ID NOs: 195–281 or 330–339. Optionally, sense strands are designed to anneal across boundaries of back-to-back antisense strands and vice-versa, as depicted in FIG. 5. The result of this particular design is that for a given recoded gene, all polynucleotides corresponding to a particular gene anneal to form recoded, double stranded genes with nicks in the phosphodiester backbone of both strands. Preferably substantially all or all amino acids of a recoded gene are encoded by at least one synthesized oligonucleotide, preferably both as a codon on the sense strand and as the complement of the codon on the antisense strand. Optionally, some oligonucleotides are also designed to encompass regions of hydrogenase genes that correspond to regions of conserved amino acid motifs and may include non-naturally occurring variations of conserved amino acid motifs, as depicted in FIG. 8.

The recoded oligonucleotides are directly introduced into annealing-based recombination reactions such as DNA shuffling, as described in Example 3. Optionally, the recoded oligonucleotides corresponding to each full recoded gene sequence are annealed, ligated, and maintained as clones until use in an annealing-based recombination reactions such as incomplete PCR extension, as described in Example 5.

Other chemically synthesized oligonucleotides and genes corresponding to parental genes sequences, chimeric sequences, and nucleotide sequences that encode non-naturally occurring amino acid sequences may also be generated, as discussed in following sections.

B. Recombination and of Recoded Nucleic Acid Sequences Using Annealing-Based Recombination Methods Oligonucleotides containing recoded hydrogenase sequences are recombined using methods that depend on sequence similarity between distinct nucleic acid sequences pooled into a reaction A number of annealing-based recombination methods may be employed.

For example, DNA shuffling may be employed as the annealing-based recombination method. DNA shuffling is a method of recombining one or more genes that perform an identical or similar function and possess at least some nucleotide sequence homology, preferably 60% or more. DNA shuffling works by randomly fragmenting two or more DNA sequences that differ by at least one nucleotide, denaturing the fragments to make them single stranded, allowing complementary or partially complementary single stranded fragments to anneal to each other, and filling in the gaps between the annealed fragments using a DNA polymerase. (For examples, see FIG. 3 and U.S. Pat. No. 5,605,793, U.S. Pat. No. 5,830,721, U.S. Pat. No. 6,117,679, and related patents). The resulting population of nucleic acid molecules can be subjected to the same process of fragmentation, denaturation, annealing, and extension through repeated cycles. The population of shuffled sequences are then expressed and analyzed for the ability to display a desired phenotype. For example, the desired phenotype can be the ability to synthesize a particular molecule or degrade a particular molecule. (for examples, see U.S. Pat. Nos. 5,837,458; 5,605,793; 6,180,406; and 6,132,970).

In alternative DNA shuffling methods, oligonucleotide fragments are synthesized and put through a shuffling reaction that does not include an initial fragmentation step. As opposed to shuffling reactions in which the parental genes are cloned fragments, in these alternative methods the parental genes are encoded by oligonucleotides synthesized to correspond to fragments of the parental gene sequences. For example, see U.S. Pat. No. 5,830,721.

In still alternative DNA recombination methods, agents that enhance recombination between sequences are included in a recombination reaction. For example, see U.S. Pat. No. 6,117,679.

Other methods of annealing-based recombination may be employed in which PCR or PCR-like extension methods are interrupted before complete synthesis of a strand has been performed. The partial synthesis generates nucleic acid fragments that may be annealed and recombined. The incomplete fragments are denatured and allowed to anneal to complementary sequences or partially complementary sequences followed by at least one more polymerase extension reaction. Incompletely synthesized fragments of different parental genes recombine by annealing and serving as a template for further extension by DNA polymerase. The extension may be interrupted through the inclusion of agents that interrupt DNA polymerase enzymes or by simply performing cycles of extension with extremely short extension times followed by heat-mediated denaturation. For example, see U.S. Pat. Nos. 5,965,408; 6,165,793; and 6,440,668.

Other methods of annealing-based recombination may be employed in which work by denaturing a gene and allowing fragments of other genes to anneal to homologous sections of the gene, followed by DNA Polymerase extension. In some variations of this method two or more single stranded fragments of genes anneal to complementary sections of a single stranded full length gene, followed by exonuclease-mediated excision of single stranded nucleotides that do not anneal. For example, see FIGS. 4–6 of U.S. Pat. No. 6,361,974.

Other annealing-based recombination methods may be employed to recombine hydrogenase sequences, such as those described in Meyerhans et al. Nucleic Acids Res 1990 April 11;18(7):1687–91, Moore et al. J Mol Biol 1997 September 26;272(3):33647, Coco et al. Nat Biotechnol 2001 April;19(4):354–9, and Coco et. al Nat Biotechnol 2002 December;20(12):1246–50.

C. Components of the Annealing-Based Recombination Reaction

Synthetic oligonucleotides corresponding to recoded hydrogenase sequences, and optionally libraries of variant oligonucleotides encoding non-naturally occurring variants of conserved amino acid motifs, are pooled and subjected to one or more annealing-based recombination reactions. The reaction may contain different combinations of oligonucleotides of varying length and sequence. Since the methods of the invention require the annealing-based recombination reaction to allow similar sequences derived from different parental genes to anneal, the inclusion of any first nucleic acid sequence in the recombination reaction that possesses significant nucleotide similarity to any other nucleic acid molecule in the reaction produces a recoded and recombined hydrogenase library in which the first nucleic acid sequence is represented.

For example, sense and antisense oligonucleotides corresponding to the entire length of recoded hydrogenase genes are included in the annealing-based recombination reaction. The oligonucleotides may be of variable length, however preferably they are at least 10 nucleotides in length and preferably at least 15 nucleotides in length. Optionally, SEQ ID NOs: 195–281 and 330–339 may also be included in the annealing-based recombination reaction by maintaining the sequences in plasmid vectors and either amplifying the sequences by PCR or releasing the sequences by restriction digest, however the invention provides synthetic oligonucleotide sequences that may be synthesized and included in an annealing-based recombination reaction without the need for maintaining the sequences as clones.

The components of one example such an annealing-based recombination reaction are depicted in FIG. 5, in which sense and antisense fragments encoding the entire length of hydrogenase genes are included in a DNA shuffling reaction. In addition, oligonucleotides corresponding to different iterations of conserved amino acid motifs are also included in the reaction FIG. 5 is not intended to depict the actual sequences to scale, nor is it limiting in the placement of particular libraries of oligonucleotides corresponding to conserved amino acid motifs. The exact boundaries between oligonucleotides encoding back-to-back sections of a full length sequence may be varied. The methods of the invention do not depend on any particular length or placement of synthetic oligonucleotide boundaries.

Any number of sets of oligonucleotides may be included in the annealing-based recombination reaction that correspond to different amino acid motifs in hydrogenase genes. In addition, a set of such oligonucleotides may include any number of non-naturally occurring sequence iterations of such an amino acid motif A single oligonucleotide may be included in the reaction that corresponds to any region of a hydrogenase gene. Although the oligonucleotide libraries in FIG. 5 are depicted to contain molecules of the same number of nucleotides, there is no reason why the oligonucleotides in a set must be of the same length or contain sequences corresponding to the same 3' and 5' boundaries. For example, a library may contain oligonucleotides that are identical in nucleotide length but staggered in the amino acid sequence they contain, such as oligonucleotide Library 1 of FIG. 5. Literally any mixture of oligonucleotides may be included in the annealing-based recombination reaction reaction. It is preferable that any oligonucleotide or other nucleic acid fragment that is included in the reaction contain enough nucleotide sequence similarity to at least one other oligonucleotide that the two are capable of annealing at temperatures high enough to prevent nonspecific annealing of nonhomologous sequences. Typical annealing temperatures in annealing-based recombination reactions range from 40° C. to 75° C., however preferred annealing temperatures are in the 50° C.–65° C. range. It is preferable that sequences in the reaction that correspond to regions of genes that encode conserved amino acid motifs possess at least 60% nucleotide identity with sequences from other genes included in the reaction. More preferably, any two such sequences possess at least 70% nucleotide identity, more preferably at least 80%, and more preferably at least 90%. As illustrated in FIGS. 9 and 10, the recoding methods of the invention alter nucleotide identity levels between sequences that encode conserved amino acid motifs in hydrogenase genes of the same class between different genes from levels in the low 40% to mid 50% range to levels in the mid 70% to low 90% range.

Optionally, wild-type genes are included in the annealing-based recombination reaction. Preferably a wild type sequence included in the reaction utilizes the same or similar codon preferences as the synthetic oligonucleotides.

PCR-based polymerization disruption methods may be chosen as the annealing-based recombination method, such as in U.S. Pat. Nos. 5,965,408, 6,165,793 and 6,440,668, and in these methods a plurality of templates and primers may be included in the reaction that correspond to recoded hydrogenase sequences and/or non-naturally occurring variant sequences of hydrogenase sequences.

Optionally, the oligonucleotides are fragmented before the annealing-based recombination reaction. Fragmentation may be performed on the pooled mixture or on individual oligonucleotides of a particular sequence. Optionally, fragmentation may be performed only on full length gene sequences prior to the annealing-based recombination reaction, such as a wild type sequence incorporated into the sequence mixture. Optionally a partial, full length, or fragmented hydrogenase sequence from the host organism is included in the sequence mixture. Fragmentation may be performed using nucleases such as DNAse I, available from sources such as Sigma Inc. St. Louis, Mo.

Preferably, the ratio of each nucleic acid molecule species in the annealing-based recombination reaction to all other nucleic acid molecule species is controlled. For example, the total number of oligonucleotide fragments corresponding to sequences that span conserved amino acid motifs in hydrogenase genes may be higher in the annealing-based recombination reaction than the total number of sequences derived from hydrogenase genes that span nonconserved regions of hydrogenase genes. This situation is depicted in FIG. 5, wherein for example oligonucleotides that encode polypeptide sequences corresponding to the conserved Fe-hydrogenase amino acid motifs PXFTSCCPXW (SEQ ID NO: 345), FXXXGGVMEAAXR (SEQ ID NO: 347) and FXEXMXCXXGCXXGGGQP (SEQ ID NO: 350) are included in higher numbers than sequences that correspond to nonconserved regions of Fe-hydrogenase proteins (single amino acid letter designation wherein X is any amino acid).

In another example, the total number of oligonucleotide fragments corresponding to a hydrogenase gene from one organism may be higher than the total number of oligonucleotide fragments corresponding to a hydrogenase gene from a different organism in the annealing-based recombination reaction. For example, the number of oligonucleotide fragments corresponding to *D. vulgaris* Fe-hydrogenase genes included in the annealing-based recombination reaction is higher than the number of oligonucleotide fragments corresponding to Fe-hydrogenase genes from other organisms. The advantage to such an approach is that characteristics of the sequences that are included in the annealing-based recombination reaction in higher proportionate numbers (to the overall number of sequences in the reaction) are represented in a larger number of the recombined sequences encoded by the recoded and recombined hydrogenase library created by the annealing-based recombination reaction. In this particular example, recoded *D. vulgaris* Fe-hydrogenase nucleotide sequences are included in the reaction in higher numbers because this particular hydrogenase protein is reversibly inhibited by the presence of Oxygen whereas many other Fe-hydrogenase proteins are irreversibly inhibited by the presence of Oxygen. A very desirable trait of a hydrogenase gene created through the methods of the invention is the ability to catalyze the creation of Hydrogen molecules in the presence of Oxygen, preferably atmospheric levels of Oxygen such as approximately 21%.

In another example, variant oligonucleotides are included in the annealing-based recombination reaction. The ratio of all variant oligonucleotides corresponding to a particular region of hydrogenase genes to each other may be the same, or alternatively variant oligonucleotides that contain an amino acid that is a conservative substitution compared to the amino acid that occupies the position in the majority of hydrogenase genes are included in the sequence mixture in a higher total amount than other variant oligonucleotides that contain an amino acid that is a nonconservative substitution. Optionally, variant oligonucleotides are designed to encompass regions of hydrogenase genes that correspond to concentrated regions of conserved amino acids, and in some instances one amino acid position that is not an invariant conserved amino acid is altered in the variant oligonucleotide to specify a different amino acid than is naturally found in that position. Preferably a set of variant polynucleotides is designed to include each possible amino acid at the variant position. Variant oligonucleotides may also be included in the annealing-based recombination reaction that contain conservative amino acid substitutions of invariant amino acids of a hydrogenase class.

Conservative amino acid substitutions are, for example, aspartic or glutamic acid as acidic amino acids; lysine/arginine/histidine as basic amino acids; leucine/isoleucine, methionine/valine, alanine valine as hydrophobic amino acids; serine/glycine/alanine/threonine as hydrophilic amino acids. Conservative amino acid substitutions do not differ significantly in their effect on maintaining (a) the structure of the peptide backbone in the area of the substitution, (b) the charge or hydrophobicity of the molecule at the target site, or (c) the bulk of the side chain. Naturally occurring residues are partitioned into groups based on common side chain properties as follows: (1) hydrophobic: met, ala, val, leu, ile; (2) neutral hydrophilic: cys, ser, thr; (3) acidic: asp, glu; (4) basic: asn, gln, his, lys, arg; (5) residues that influence chain orientation: gly, pro; and (6) aromatic; trp, tyr, phe. The invention also envisions variant oligonucleotides encoding non-conservative substitutions. Non-conservative substitutions entail exchanging a member of one of the classes described above for another.

In addition to the synthesis of recoded sequences, in some instances it may be desirable to incorporate certain elements of hydrogenase genes into all or substantially all recombined hydrogenase genes in a recoded and recombined hydrogenase library. For example, the Fe-hydrogenase of *C. reinhardtii* has a 56 amino acid transit peptide that targets the enzyme to the chloroplast stroma. Since not all Fe-hydrogenases are targeted to the chloroplast stroma or are found in organisms that have chloroplasts, it is desirable when utilizing *C. reinhardtii* as a host organism for expression of a recoded and recombined hydrogenase library to include in the annealing-based recombination reaction chimeric oligonucleotides that encode the *C. reinhardtii* transit peptide sequences at one end and at least 10 nucleotides corresponding to N-terminal amino acids of other recoded Fe-hydrogenase genes. Oligonucleotides corresponding to the sense strand have the *C. reinhardtii* signal sequence on their 5' end and nucleotides corresponding to another Fe-hydrogenase sequence on their '3 end. The reverse it true for the corresponding antisense strand. It is not necessary that the amino acids encoded by the oligonucleotide that correspond to the non-*C. reinhardtii* Fe-hydrogenase be the farthest N-terminal amino acids, but it is preferable that they be located on the N-terminal side of all highly conserved amino acids in the protein. The chimeric oligonucleotides anneal to complementary nucleotide sequences and allow all or substantially all hydrogenase genes in the recoded and recombined hydrogenase library to contain a transit peptide that targets the encoded protein to the chloroplast stroma Example of such chimeric oligonucleotides are SEQ ID NOs: 340–342, which encode the sense strand of the recoded *C. reinhardtii* transit peptide sequence (from SEQ ID NO: 219) and nucleotides that encode 15 amino acid N-terminal regions of the *Trichomonas vaginalis, Neocallimastix frontalis*, and *Giardia intestinalis* Fe-hydrogenases, respectively. Each chimeric oligonucleotide utilizes most preferred *C. reinhardtii* codons according to FIG. 4.

In an example of a non-annealing-based mutagenesis reaction, hydrogenase genes, preferably recoded to most preferred codons of a host organism, may be subjected to saturation mutagenesis and then assayed for the production of Hydrogen in the host organism. Saturation mutagenesis is a technique described previously in which all 20 amino acids are substituted in a particular position in a protein and clones corresponding to each variant are assayed for a particular phenotype. For example, see U.S. Pat. Nos. 6,171,820 and 6,358,709. Although any amino acid may be substituted in a saturation mutagenesis experiment, the most likely amino acids that may be substituted to create novel hydrogenase genes that exhibit properties such as Oxygen tolerance are amino acids that are not invariant between all hydrogenases of a class, and are directly adjacent to one or two invariant active site amino acids of the class. For example, the X residue in the Fe-hydrogenase GGVMEAAXR (SEQ ID NO: 349) motif is a candidate for saturation mutagenesis.

Novel hydrogenase genes other than SEQ ID NOs: 88–174 and 185–194 may be obtained, recoded, and included in an annealing-based recombination reaction in addition to the sequences disclosed herein or to the exclusion of sequences disclosed herein. Such novel hydrogenase genes may be obtained from several methods. For example, probe nucleic acid molecules corresponding to conserved amino acid motifs, particularly enzyme active site residues, may be immobilized and libraries of denatured genomic or cDNA sequences from a plurality of microbes may be hybridized to the probe. Nucleic acid sequences corresponding to proteins that perform similar or identical functions as the protein from which the probe was derived are isolated using these techniques. It is preferable to use degenerate probes that utilize different codons but encode the same amino acid sequences so as to maximize the chances of isolating genes from microorganisms that utilize a diverse assay of codon usage regimes. For example, see U.S. Pat. Nos. 6,368,798 and 6,344,328. Other methods of isolating novel hydrogenase genes include placing microbes under conditions sufficient to induce the expression of hydrogenase genes, such as anaerobic conditions, followed by the isolation of mRNA. For example, exposing green algae to anaerobiosis or Sulfur deprivation induces the expression of hydrogenases. See U.S. patent application Ser. No. 10/287,750, and Zhang at el., Planta (2002) February;214(4): 552–61. cDNA libraries are then generated from the microbes using standard techniques, and the libraries are sequenced to identify novel hydrogenases. Alternatively to generating cDNA libraries, hydrogenase genes may be identified from mRNA samples by RT-PCR amplification using primers that correspond to highly conserved motifs in hydrogenase proteins. For example, RT-PCR is performed using degenerate sense oligonucleotides that encode the Fe-hydrogenase motif PXFTSCCP (SEQ ID NO: 346) and antisense oligonucleotides that encode the Fe-hydrogenase motif GCXXGGGQP (SEQ ID NO: 351). In addition, polydT oligonucleotides may be used along with an upstream primer corresponding to a conserved motif. RT-PCR products are then sequenced and longer or full length hydrogenase sequences are determined using other standard PCR techniques such as RACE-PCR. Novel hydrogenase sequences, which need not be full length sequences, are recoded and included in an annealing-based recombination reaction.

Additionally, genes encoding hydrogenase proteins sequences other than those set forth in SEQ ID NOs: 88–174 and 185–194 may be employed in annealing-based recombination reactions by mutation of the genes that encode SEQ ID NOs: 88–174 and 185–194 to encode functional variants of SEQ ID NOs: 88–174 and 185–194. For example, any hydrogenase gene that possesses at least 60% nucleotide identity with a segment of another nucleotide sequence over a stretch of nucleotides at least 10 nucleotides, preferably 15 nucleotides, and more preferably 20 or 30 nucleotides may be utilized in the methods of the invention.

D. Results of Recoding on Exploration of Protein Function

The recoded and recombined hydrogenase libraries created by the annealing-based recombination methods of the invention allow for the functional exploration of gene sequences that would not be incorporated into libraries using traditional annealing-based recombination methods. This is because hydrogenase genes from different organisms do not always display significant nucleotide sequence homology despite the fact that they encode similar amino acid sequences. Nucleotide sequences that do not possess significant homology to other sequences included in the same annealing-based recombination reaction do not anneal during the reaction, and therefore these sequences do not recombine. In addition, since the invention provides sequences that are recoded to utilize most preferred codons in the host organism in which the recoded and recombined hydrogenase libraries are expressed, the invention allows for all sequences in the library to be translated with maximum efficiency by the host organism. The invention therefore prevents sequences in a hydrogenase library that encode proteins with desirable qualities from being missed in the screening or selection assay due to poor translation. For instance; using traditional annealing-based recombination methods, a region of high conservation (such as the PXFTSCCPXW (SEQ ID NO: 345) motif of Fe-hydrogenases) encoded by a sense oligonucleotide from one organism and an antisense oligonucleotide from a different organism might in some instances allow the sequences to anneal and recombine, however if the codons in any region of one of the oligonucleotides are not preferred in the host organism then despite the successful annealing and recombination of the sequences, proteins encoded by the resulting recombined gene are poorly translated. In other instances the different codon usage in the two genes causes such oligonucleotides to not anneal and recombine at all.

To illustrate one benefit of the invention, two sequences of Fe-hydrogenase genes were compared using the BLAST program before and after recoding. The nucleotide sequences of wild-type *Chlamydomonas reinhardtii* Fe-hydrogenase (SEQ ID NO: 112) and wild-type *Clostridium perfringens* (SEQ ID NO: 98) were compared using the pairwise analysis module of the BLASTN version 2.2.4 program under the following parameters: Match: 1; Mismatch:-2; gap open: 5; gap extension: 2; x_dropoff: 50; expect: 10.000; wordsize: 11; Filter: on. The result indicated no significant nucleotide sequence similarity between the two gene sequences. Some portions of the two sequences demonstrated limited identity in regions corresponding to highly conserved amino acids, as depicted in FIGS. 9 and 10. For example, FIGS. 9 and 10 demonstrate that 82, 96, 70, and 27 base pair segments of the two wild-type sequences that correspond to highly conserved amino acid sequences possess only 56.1%, 42.7%, 52.9%, and 55.5% nucleotide identity, respectively. After the sequences were recoded to conform to the codon usage of most preferred *Chlamydomonas reinhardtii* codons depicted in FIG. 4, the two recoded sequences (SEQ ID NO: 219 and SEQ ID NO: 205) were run through the pairwise analysis module of the BLASTN program under the same experimental parameters as with the wild-type sequences above. As depicted in FIGS. 9 and 10, the same regions possess 87.8%, 74.0%, 78.6%, and 92.6% nucleotide identity, respectively. Fe-hydrogenase sequences of SEQ ID NOs: 195–281 and NiFe-hydrogenase SEQ ID NOs: 330–339 are therefore superior to the corresponding wild-type Fe-hydrogenase sequences of SEQ ID NOs: 88–174 and NiFe-hydrogenase SEQ ID NOs: 185–194 for purposes of annealing-based recombination methods. The invention provides methods of manipulating nonidentical but homologous gene sequences to make them more likely to anneal and therefore recombine in annealing-based recombination reactions. Since annealing-based recombination methods require at least 60% nucleotide identity between segments of genes in order to recombine, and preferably 70% or more, much larger numbers of gene sequences are effectively recombined using the methods of the invention than with traditional annealing-based recombination methods, with the result that a deeper exploration of hydrogenase sequences is performed.

The effect of recoding also provides the benefit that the host organism efficiently translates any region of a recoded gene. To illustrate this benefit, FIG. 14 depicts the wild-type sequence of *Entamoeba histolytica* Fe-hydrogenase (SEQ ID NO: 91). Codons that are preferred in *C. reinhardtii* are depicted in large font while nonpreferred codons are depicted in small font. FIG. 15 depicts the recoded sequence of *Entamoeba histolytica* Fe-hydrogenase (SEQ ID NO: 198). All codons are the most preferred in *C. reinhardtii*. Any region of the recoded Fe-hydrogenase gene is efficiently translated in *C. reinhardtii* when it is used as the host organism for expression of recoded and recombined hydrogenase libraries that include segments of SEQ ID NO: 198. Any fragment of the recoded *Entamoeba histolytica* Fe-hydrogenase that possesses amino acid homology with any other Fe-hydrogenase is both (1) more likely to recombine with any other Fe-hydrogenase nucleotide sequence recoded to the same or similar codon preferences and (2) effectively translated in a host organism that the wild-type *E. histolytica* Fe-hydrogenase sequence has been recoded to conform with. The recoding of wild type hydrogenases provides for expanded exploration of hydrogenase sequences over traditional annealing-based recombination methods.

IV Assay for Desired Phenotyoes

A. Expression of Recoded and Recombined Hydrogenase Library

The recoded and recombined hydrogenase library is inserted into a nucleic acid vector which is then transformed into a population of host cells. Standard transformation methods are used for *C. reinhardtii*. See for examples see Kindle et al., Proc Natl Acad Sci USA (1991) March 1;88(5):1721–5; Kindle, Meth Enzymology (1998) 297: 27–38, Shimogawara et al., Genetics (1998) April;148(4): 1821–8, Randolph-Anderson et al., Mol Gen Genet (1993) January;236(2–3):235–44, and Rochaix J-D et al. (1998) The Molecular Biology of Chloroplasts and Mitochondria in *Chlamydomonas* (Advances in Photosynthesis, Vol 7). Transformation methods for other microbes such as photosynthetic bacteria and cyanobacteria are also known. (for examples see Wirth et al., Mol Gen Genet 1989 March;216 (1):175–7, Koksharova et al., Appl Microbiol Biotechnol 2002 February;58(2):123–37). Transformation methods and selectable markers for use in bacteria such as *E. coli* are also known (for examples see Maniatis et al. (1989) Molecular Cloning: A Laboratory Manual Cold Spring Harbor Laboratory). The vector may contain any number of additional components besides the recoded and recombined hydrogenase sequences, including but not limited to promoters, screenable or selectable markers, other genes that can be expressed besides hydrogenase genes, and structural sequences that aid in maintenance of the vector sequence in the cell such as centromeres.

For example, selectable markers amenable for use in *Chlamydomonas* include markers imparting spectinomycin resistance (Fargo et al., Mol Cell Biol (1999) October;19 (10):6980–90), kanamycin and amikacin resistance (Bateman et al., Mol Gen Genet (2000) April;263(3):404–10), zeomycin and phleomycin resistance (Stevens et al., Mol Gen Genet (1996) April 24;251(1):23–30), and paromycin and neomycin resistance (Sizova et al., Gene (2001) October 17;277(1–2):221–9). Screenable markers are also available in *Chlamydomonas*, such as the green fluorescent protein (Fuhrmann et al., Plant J (1999) August;19(3):353–61) and the *Renilla luciferase* gene (Minko et al., Mol Gen Genet (1999) October;262(3):421–5). Many other selectable marker systems are available in bacterial cells and other microbial cells that are known in the art (for examples see Sambrook et al., Molecular Cloning, A Laboratory Manual, Cold Spring Laboratory Press, Cold Spring Harbor, N.Y. (1989)).

Genes in the vector are driven by any type of promoter, such as inducible or constitutive promoters. For example, in *Chlamydomonas*, a promoter sequence that imparts transcriptional activation when a cell is exposed to light may be incorporated into the vector (for examples see Hahn et al., Curr Genet (1999) January;34(6):459–66, Loppes et al., Plant Mol Biol 2001 January;45(2):215–27, and Villand et al. Biochem J 1997 October 1;327 (Pt 1):51–7). Other light-inducible promoter systems may also be used, such as the phytochrome/PIF3 system (see Shimizu-Sato et al., Nat Biotechnol 2002 October;20(10): 10414). Other promoters may be used that activate expression when a cell is exposed to light and heat (for examples, see Muller et al., Gene (1992) February 15;111(2):165–73, von Gromoff et al., Mol Cell Biol (1989) September;9(9):3911–8). Other promoters may be used that activate expression when a cell is exposed to darkness (for example, see Salvador et al., Proc Natl Acad Sci USA 1993 February 15;90(4):1556–60). Alternatively the promoter sequence imparts transcriptional activation when an exogenous molecule is added to the culture media using receptors not present in the wild-type cell such as receptors for estrogen, ecdysone, or others (Metzger et al., Nature 1988 July 7;334(6177):31–6, No et al. Proc Natl Acad Sci USA 1996 April 16;93(8):3346–51). Alternatively a constitutive promoter can be used such as the promoter of the RBCS2 or psaD genes (see Stevens et al., Mol Gen Genet (1996) April 24;251(1):23–30 and Fischer, WO 01/48185). Promoter sequences in bacterial cells and other microbes are also known (for examples see Sambrook et al., Molecular Cloning, A Laboratory Manual, Cold Spring Laboratory Press, Cold Spring Harbor, N.Y. (1989)).

B. Culture of Cells Expressing the Recoded and Recombined Hydrogenase Library

The host organism cells may be cultured in many types of media containing different components. The culture media may also be solid or liquid. Preferably the cells are cultured in liquid media since a desired strain that is capable of generating large amounts of Hydrogen in the presence of Oxygen is commercially deployed in liquid media for growth in sunlit conditions in minimal culture media. Growth media for *Chlamydomonas* cells, such as Sager's Minimal Media or Hunter Trace Element Media, are described in sources such as Harris E., (1989) The *Chlamydomonas* Sourcebook. Academic Press, New York and Rochaix J-D et al. (1998) The Molecular Biology of Chloroplasts and Mitochondria in *Chlamydomonas* (Advances in Photosynthesis, Vol 7). Minimal media is preferred when the host organism is or can be photoautotrophic because it is desirable to evolve microbes to generate Hydrogen using only sunlight as energy. Standard growth media for other types of cells such as bacteria, cyanobacteria, and photosynthetic bacteria are known (see Maniatis et al. (1989) Molecular Cloning: A Laboratory Manual Cold Spring Harbor Laboratory; Masukawa et al., Appl Microbiol Biotechnol 2002 April;58(5):618–24; and Papen et al., Biochimie 1986 January;68(1):121–32).

Any component of the culture media may be manipulated. For example, a selection molecule such as an antibiotic is added to the culture media and a corresponding selectable marker gene is incorporated into the transformation vector containing the recoded and recombined hydrogenase library.

Optionally, other components of the culture media are manipulated such as amount of Sulfur in the media The level of Sulfur may be increased, decreased, or held constant throughout the period of culture. For example, the recoded and recombined library of Fe-hydrogenases is transformed into *C. reinhardtii* and the cells are put under Sulfur deprived conditions for a certain number of hours. The Sulfur is then added in an incremental fashion back to the media. (see Melis et. al. Plant Physiol (2000) January;122(1):127–36 and Zhang et al. Planta (2002) February;214(4):552–61).

Another component that may be optionally added to the culture media is metronidazole (MNZ). MNZ is a strong oxidizer of reduced ferredoxin. Ferredoxin accepts electrons from the Photosystem I complex and transfers them to the hydrogenase to supply electrons for the $2H^{+}+2e^{-} \rightarrow H_2$ reaction. Although the mechanism of MNZ's function is not necessary to understand in order to practice the invention, it is believed that MNZ exhibits a its toxic mechanism of action on cells by taking high energy electrons out of the electron transport chain and diverting them from the energy production machinery of the cell. The more electrons MNZ accepts from reduced ferredoxin, the more $H_2O_2$ is produced that can kill the cell. The mechanism is proposed to occur through reduced MNZ being oxidized by $O_2$, yielding a superoxide radical which then disproportionates into $H_2O_2$. Since reduced ferredoxin transfers electrons to the Fe-hydrogenase during $H_2$ production, a mutant *C. reinhardtii* strain capable of more efficiently shuttling electrons to the Fe-hydrogenase than another strain is able to survive better than a cell that less efficiently shuttles electrons to the Fe-hydrogenase in the presence of MNZ. When MNZ is added to the culture media a controlled amount of Oxygen is also added to the culture container and cells that survive are assayed for $H_2$ production In a typical experiment, *C. reinhardtii* cells that survive the MNZ treatment protocol, cultured for example in Saeger's minimal media in 20 mM MNZ; 1 mM Sodium Azide; 2% Oxygen; 200 W/m² light for 20 minutes, with expression of the recoded and recombined hydrogenase library, are placed in liquid culture media in multiwell plates and assayed for $H_2$ production It is unnecessary to count the number of independent transformants that survive the MNZ treatment. Any transformant that survives the treatment is capable of producing more $H_2$ under a certain level of Oxygen than a wild-type cell, and therefore all survivors are assayed for $H_2$ production without regard to the number or percent of mutant survivors. For an example of the use of MNZ, see U.S. Pat. No. 5,871,952.

Optionally, a library of mutant ferredoxin genes is also used to transform the host cells on the same or a different nucleic acid vector as the recoded and recombined hydrogenase library. The ferredoxin library is generated by annealing-based or non-annealing-based mutagenesis methods. For example when the host organism is *C. reinhardtii*, the *C. reinhardtii* wild-type ferredoxin gene (SEQ ID NO: 343) or the *C. reinhardtii* ferredoxins gene recoded, for example, according to FIG. 4, is subjected to error-prone PCR and coexpressed with the hydrogenase library. For instance, the vector used to transform a *C. reinhardtii* strain contains at least one screenable or selectable marker, a member of a library of ferredoxin genes created by error-prone PCR using a *C. reinhardtii* or other ferredoxin gene as a template, and a member of a recoded and recombined library of Fe-hydrogenase genes. Alternatively, ferredoxins isolated from the same organisms that hydrogenases are isolated from are recoded and recombined using an annealing-based recombination Recoded and recombined hydrogenases and ferredoxins are then coexpressed in a host organism.

Oxygen content may be manipulated in the culture container. The amount of Oxygen in the culture container may be directly adjusted through gas exchange or indirectly by allowing or inducing the water-splitting mechanism of photosynthesis. The Oxygen content, like all other culture parameters, may be manipulated throughout the culture period or held constant. The presence of some amount of Oxygen is preferred if MNZ is added to the culture media. Preferred hydrogenase genes are capable of catalyzing the production of $H_2$ in the presence of Oxygen. A preferable amount of Oxygen in a culture of commercially deployed cells for $H_2$ production is an atmospheric level such as approximately 21%. Several rounds of screening or selection may be performed using the methods of the invention in which the Oxygen content of the culture container may be increased between each successive round while $H_2$ production is assayed. For example, a culture is exposed to 5% Oxygen in the first screening or selection round, 10% Oxygen in the second screening or selection round, 15% Oxygen in the third screening or selection round, and 20% Oxygen in the fourth screening or selection round. In another example, cells are screened or selected for generation of hydrogen in the presence of more than 0.5% oxygen.

Optionally a chemical mutagenesis-inducing agent may be added to the culture media at any time. The cells are cultured for at least 15 minutes, and optionally as long as desired. At any point after the addition of the mutagen to the culture media the cells may be assayed for the production of Hydrogen. The culture as a whole may be assayed for Hydrogen production or the population may be partitioned and smaller groups of cells, including single independent transformant cells, each group being separately assayed for Hydrogen production.

At one or more time points during the evolution process a sample of the population may be removed from the culture container. A DNA sample from each cell sample may then be taken and characterized. One type of characterization that the invention provides is the sequencing of Fe-hydrogenase genes from the library before, after, and during the screening or selection process. Sequences that are deleterious to Hydrogen production in Oxygen disappear during a selection process and hydrogenase sequences may be monitored at a plurality of time points. Any other genetic variant sequence anywhere else in the genome of surviving cells may also be determined using a variety of methods before, after, and during the screening and selection process.

The temperature of the culture container and media may also be varied. Since the $H_2$ production assay conditions preferably mimic commercial deployment culture conditions, strains may be selected for the ability to generate $H_2$ as quickly as possible after shifting from dark/cold conditions to warm/light conditions that mimic sunrise in a commercial deployment setting. Cells that produce large amounts of $H_2$ may also be further selected for the ability to survive low temperatures in minimal media that mimic the cold nighttime temperatures of a culture container deployed, for example, in a desert setting. Hydrogen production may be assayed over a period of time such as 24 hours to identify strains that are able to produce Hydrogen for sustained periods of time under shifting light and temperature conditions. For example, the light intensity from a light source on the cells at times 0, 3, 6, 9, 12, 15, 18, 21, and 24 hours is 2, 22.5, 65, 22.5, 2, 0.25, 0.25, 0.25, and 2 μm-2 s-2, respectively. The air temperature in the area of the culture container is 15° C., 25° C., 35° C., 25° C., 15° C., 12° C., 12° C., 12° C., and 15° C. at times 0, 3, 6, 9, 12, 15, 18, 21, and 24 hours, respectively. The temperature of the culture container and the media is allowed to fluctuate with the temperature of the air. Hydrogen production is measured at hourly time points and strains that generate sustained hydrogen production are identified.

V Mating

Optionally cells are allowed or induced to mate and recombine genomes and are then assayed for desirable phenotypes. Mating protocols for *C. reinhardtii* are known (see Harris E., (1989) The *Chlamydomonas* Sourcebook. Academic Press, New York and Rochaix J-D et al. (1998) The Molecular Biology of Chloroplasts and Mitochondria in *Chlamydomonas* (Advances in Photosynthesis, Vol 7). Other microbes may be mated for the purpose of recombining genomes using a variety of protocols. For an example, Zhang et al., Nature 2002 February 7;415(6872):644–6. For example, two or more strains of an organism may be mated and allowed to recombine genomes followed by assay for a desired trait. The advantage of mating cells that contain different genetic backgrounds is to select for multiple variant sequences that synergistically or additively contribute to the generation of a desired phenotype. Mating is not required in order to practice the invention.

In one embodiment of the invention, $H_2$ producing cells are mated to other strains of the same species or subspecies. For example, an insertion library is constructed in which a transposable element is randomly inserted into the *C. reinhardtii* genome. For examples of transposable elements in *C. reinhardtii*, see, for example, Wang et al. Plant Mol Biol 1998 November;38(5):681–7, Day, Plant Mol Biol 1995 June;28(3):437–42. The genome of *C. reinhardtii* may also be mutated randomly by inserting nucleic acid sequences using transformation methods previously described, such as Kindle et al., Proc Natl Acad Sci USA 1991 March 1;88(5): 1721–5. In order to mutate all portions of the *C. reinhardtii* genome, the mutagenesis is performed on the mitochondrial, nuclear, and chloroplast genomes as described in previously cited methods. The mitochondrial, nuclear, and chloroplast insertion libraries are simultaneously mated to $H_2$ producing *C. reinhardtii* transformants containing at east one recoded and recombined hydrogenase gene and $H_2$ production is assayed. For example, the genomes of some insertion mutants that have a gene disrupted that is deleterious for the production of $H_2$ are recombined with genomes of Oxygen tolerant hydrogenase variants created through the annealing-based recombination method. Such cells produce larger amounts of $H_2$ than either parent. As an example, enzymes that convert energy storage molecules such as simple starches into less accessible energy storage molecules such as complex starches may be deleterious to maximal amounts of Hydrogen production.

In another embodiment, isolates of different *Chlamydomonas* strains that possess variant single nucleotide polymorphism (SNP) positions and therefore have different genomic backgrounds but are still capable of mating with each other and with a host strain are mated to host strain transformants that have already demonstrated Oxygen tolerant hydrogenase activity from an earlier assay of a recoded and recombined hydrogenase library. Sections of genomic DNA that contain SNPs throughout the genome that impart variations in the ability of the cells to produce $H_2$ are recombined with Oxygen tolerant hydrogenase variant sequences created through the annealing-based recombination method in cells produced by the mating protocol. Such cells produce larger amounts of $H_2$ than either parent.

In another embodiment, RNA interference (RNAi) constructs are synthesized corresponding to all genes identified in the completed *C. reinhardtii* genome sequence. The complete genome sequence of *C. reinhardtii* is available at http://www.biology.duke.edu/chlarny_genome/index.html, and therefore constructs to inactivate all genes in the genome through RNAi are designed and synthesized. RNAi works by producing a single double stranded RNA molecule with the same sequence as a targeted mRNA as well as the complement of that sequence encoded by the same molecule and folded back hybridizing on itself. For examples, see Fire et al., Nature (1998) February 19;391(6669):806–11 and Fuhrmann et al., J Cell Sci (2001) November;114(Pt 21): 3857–63. Expressed RNAi constructs cause their target mRNA to be degraded and not translated, effectively silencing the gene. Two sets of constructs are created for each *C. reinhardtii* gene, wherein one construct is driven by a promoter activated by light and the other construct is driven by a promoter activated by dark. Examples of dark and light activated promoter sequences in *C. reinhardtii* have been previously described in earlier sections. *C. reinhardtii* are transformed with the dark-induced and light-induced constructs that optionally contain selectable markers and cells that retain the constructs are mated with transformants that have already demonstrated Oxygen tolerant hydrogenase activity from an earlier assay of a recoded and recombined hydrogenase library. Since *C. reinhardtii* can only generate $H_2$ using only light as an energy source when light is available, this mating protocol selects for novel strains that are adapted to conditions that mimic commercial deployment. It is desirable to generate strains of organisms such as *C. reinhardtii* that efficiently produce $H_2$ when light is available and conserve energy effectively when light is not available. Some genes inactivated by an RNAi construct are deleterious to the production of $H_2$ when light is available while other genes inactivated by an RNAi construct are deleterious to the conservation of energy when light is not available. This mating protocol therefore generates strains of *C. reinhardtii* that generate $H_2$ in the presence of Oxygen and are more effective at conserving energy during dark and producing $H_2$ during light than any parent strain. Of course, the *C. reinhardtii* that are transformed with the dark-induced and light-induced constructs may be assayed for $H_2$ production without being mated with stains that contain recoded and/or recombined hydrogenase genes. RNAi constructs may also be created and expressed in organisms other than *C. reinhardtii*.

Wild-type cells may be subjected to mutagenic agents such as ethidium bromide and nitrosoguanadine to generate a mutated population of cells. The mutated population may be mated to cells containing Oxygen tolerant hydrogenase variants created through an annealing-based recombination method.

Mating of cells after initial selection for Oxygen tolerant hydrogenase variants created through an annealing-based recombination method allows specifically designed variations, such as those present in recoded and recombined hydrogenase genes, to be tested for increased $H_2$ production under different genomic backgrounds that confer other desirable traits such as energy conservation during darkness. Cells may also be allowed to mate as culture parameters are modified, such as while increasing amounts of MNZ and Oxygen are added to a culture.

VI Assay for Hydrogen Production

One or more independent transformants or a population of independent transformants containing mutagenized nucleic acid sequences such as recoded and recombined hydrogenase genes are assayed for $H_2$ production. $H_2$ may be detected using a variety of methods such chemochromic sensing films that contain transition metals (see U.S. Pat. No. 6,277,589). Such films change from clear to dark grey-blue when exposed to $H_2$, and when placed in proximity to cells that produce different amounts of $H_2$ they identify cells that produce more $H_2$ than others. There are other methods, both direct and indirect, that are used to detect hydrogen, such as spectroscopic methods (see U.S. Pat. Nos. 5,100,781 and 6,309,604). Other types of gas sensors and films suitable for detection of hydrogen are known in the art. See U.S. Pat. Nos. 5,100,781, 6,484,563, 6,265,222 and 6,006,582.

For example, a chemochromic film is placed on top of a plate of culture wells containing liquid culture media, with one or more culture wells containing one or more independent transformants containing at least one copy of the vector that contains a recoded and recombined hydrogenase gene. The film is placed against the plate such that each well is sealed or partially sealed from the outside atmosphere. Preferably the culture media does not fill the well so that a space of gas separates the media from the film. The culture plates are clear, and are exposed to light, such as 60 µE $m^{-2}$ $s^{-2}$, for a period of time such as one hour, preferably under controlled atmospheric conditions such as 2.5% Oxygen/97.5% Nitrogen. The amount of color change in the film at each spot above a culture well is then measured, preferably in a quantitative fashion, using techniques such as densitometry or other scanning methods. Alternatively, a digital camera photographs the film immediately after exposure to the transformed cells. Films may also be analyzed by visual inspection. Parameters such as the length and intensity of light exposure before the film is placed over the culture wells for the $H_2$ assay may be varied. For example, strains that are capable of sustained $H_2$ production over the course of a 12 hour period in which the intensity of light is increased and decreased to roughly correspond to daylight may be isolated by performing the $H_2$ assay after the cells have been producing $H_2$ for 10 hours. Such strains may be created by mating hydrogenase containing transformants with other cells that possess mutations that alter energy utilization, conservation, and stockpiling pathways, and other phenotypes.

Since the assay conditions preferably mimic commercial deployment culture conditions, it is preferable to assay cells in liquid culture rather than on solid growth media Mutants that possess inferior qualities such as decreased phototaxis (ie: the ability to swim toward light) are avoided by performing the $H_2$ assay in liquid culture.

Strains of cells that produce the most Hydrogen are selected for further manipulation or commercial hydrogen production or both.

Having generally described the invention, the same will be more readily understood by reference to the following examples, which are provided by way of illustration and are not intended as limiting.

EXAMPLE 1

The *Clamydomonas reinhardtii* Fe-hydrogenase amino acid sequence (SEQ ID NO: 24) was subjected to the Basic Local Alignment Sequence Tool (BLAST) at the National Center for Biotechnology Information. A total of 105 sequences were matched, all but one of which were distinct from the input sequence. A single self-match was reported as a 100% sequence identify. Parameters for the BLAST search were as follows: the peptide sequence database searched was the nr database (Database: All non-redundant GenBank CDS translations+PDB+SwissProt+PIR+PRF); Matrix: BLOSUM62; Gap Penalties: Existence: 11, Extension: 1. 87 unique protein sequences were identified that possess E values of $4^{e-05}$ or smaller (SEQ ID NOs: 1–87). Some proteins were identified that met the E value criteria but either did not appear to be hydrogenase genes, possessed significant homology to the *C. reinhardtii* Fe-hydrogenase protein but did not contain amino acids critical to the Fe-hydrogenase active site, or were positively identified as having functions other than hydrogenase activity in the BLAST entry (protein sequences corresponding to accession numbers gi:15020824, gi:16754852, gi:13385742, gi:26335839, gi:12851667, gi:22654872, gi:14336719, gi:10438504, gi:18414657, gi:27691020, gi:20807184, gi:4930041 and gi:20807368). The scores (other than the self-match) ranged from a high score of 628 with an E value of $e^{-179}$ of to a low of a score of 49 with an E value of $e^{-04}$. Sequences from microbes, vertebrates, invertebrates, and plants were obtained. cDNA sequences corresponding to each amino acid sequence were obtained.

cDNA sequences (comprising SEQ ID NOs: 88–174) were obtained that correspond to the amino acid sequences of SEQ ID NOs: 1–87. SEQ ID NOs: 88–174 were recoded to contain only the most preferred codons of *Chlamydomonas reinhardtii* shown in FIG. 4 to obtain cDNA sequences of SEQ ID NOs: 195–281. Because no codons were altered to specify different amino acids in the recoding process, the cDNA sequences of SEQ ID NOs: 195–281 also encode the proteins set forth in SEQ ID NOs: 1–87. A total of 24,003 codons contained in SEQ ID NOs: 88–174 were recoded to most preferred *C. reinhardtii* codons illustrated in FIG. 4.

EXAMPLE 2

A collection of NiFe-hydrogenase genes encoding hydrogenases that preferentially catalyze the formation of molecular hydrogen over the consumption of molecular Hydrogen were obtained that correspond to SEQ ID NOs: 185–194. These wild-type cDNA sequences correspond to the small and large subunit genes of the NiFe-hydrogenase catalytic heterodimer. The wild-type NiFe-hydrogenase cDNA sequences were recoded to utilize the same codon for each amino acid to generate SEQ ID NOs: 330–339. The cDNA sequences were recoded to utilize only the most preferred codons in *E. coli* strain K12, as illustrated in FIG. 13. A total of 2050 codons from SEQ ID NOs: 185–194 were recoded to most preferred *E. coli* strain K12 codons.

EXAMPLE 3

Nucleic acid sequences corresponding to SEQ ID NOs: 88–174 are recoded according to the most preferred codons in *Chlamydomonas reinhardtii*, as illustrated in FIG. 4, to generate nucleic acid sequences according to the sequences set forth in SEQ ID NOs: 195–281. Synthetic genes of SEQ ID NOs: 195–281 are created by annealing sense and antisense oligonucleotides corresponding to all segments of SEQ ID NOs: 195–281 followed by ligation and PCR, generally following the methods of Fuhrmann et al., Plant J 1999 August;19(3):353–61. The genes are then cloned and maintained in expression vectors known in the art.

Using methods generally set forth in U.S. Pat. Nos. 5,605,793, 6,132,970, and 6,180,406, the synthetic genes of SEQ ID NOs: 195–281 are put through a reassembly protocol using cycles of denaturation, annealing, and extension. Clones of SEQ ID NOs: 195–281 are first fragmented using DNaseI. About 5 μg of the cloned genes are digested with 0.15 units of DNAseI (Sigma, St. Louis, Mo.) in 100 μl of 50 mM Tris-HCl pH 7.4, 1 mM $MgCl_2$, for 10 min at room temperature. Fragments of 50–200 bp are then purified using low-melting temperature agarose gel electrophoresis. Alternatively the fragments are isolated from gel slices by electroelution.

The purified fragments are resuspended in a PCR reaction mixture containing 0.2 mM each dNTP, 2.2 mM $MgCl_2$, 50 mM KCl, 10 mM Tris-HCl pH 9.0, and 0.1% Triton X-100, at a concentration of 10–30 ng DNA fragments per μl. The reaction is then put through 45 cycles of reassembly in a thermocycler for one cycle of 94° C. for 60 seconds followed by 45 cycles of 94° C. for 30 seconds, 50° C. for 30 seconds, and 72° C. for 30 seconds, followed by 5 minutes at 72° C. PCR products are generated from the reassembled fragments using primers that correspond to N-terminal sense and C-terminal antisense sequences derived from the first and last 25 nucleotides of SEQ ID NOs: 195–281. The reaction is performed using a 20 cycle reaction comprising one cycle of 94° C. for 60 seconds followed by 20 cycles of 94° C. for 30 seconds, 50° C. for 30 seconds, and 72° C. for 30 seconds, followed by 5 minutes at 72° C.

The library of recombined sequences is cloned into an expression vector containing a promoter capable of expressing the sequences in *C. reinhardtii*, such as the psaD promoter (see WO 01/48185) or RBCS2 promoter (see Kozminski et al., Cell Motil Cytoskeleton 1993;25(2):158–70) and at least one marker gene that confers the ability to screen or select for the presence of vector sequences. An example of a marker available for use in *C. reinhardtii* is the gene imparting resistance from phleomycin (see Stevens et al., Mol Gen Genet (1996) April 24;251(1): 23–30).

Transformed *C. reinhardtii* cells are individually placed in liquid Sager's minimal media in a multi-well culture plate and cultured under light of approximately 55 μE $m^{-2}$ $s^{-2}$. Phleomycin or another selection molecule that corresponds to the selectable maker gene in the vector is also contained in the culture media at an appropriate concentration as described in Stevens at al. The gaseous atmosphere of the culture chamber comprises approximately and 5% Oxygen. The multi-well culture plate is substantially clear and allows light to pass through. The cells are cultured for approximately 12 hours under light of approximately 55 $μm^{-2}$ $s^{-2}$ conditions. Hydrogen production is measured by the placement of a hydrogen detecting film on top of the multi-well culture plate that substantially seals the culture wells from the atmosphere in the chamber. An example of such a chemochromic film that changes color in response to $H_2$ can be found in U.S. Pat. No. 6,277,598, however others are also described in previous sections. Light of approximately 55 $μm^{-2}$ $s^{-2}$ illuminates the culture container(s). After the film has been positioned over the culture wells for 20 minutes, the film is moved to a position adjacent to the culture containers and is photographed on top of a white background. Spots in the film corresponding to each culture well are quantitated using densitometric methods or digital photography. Cells are removed from wells that correspond to the darkest 5% of all spots on the film and are cultured further. Fe-hydrogenase sequences are recovered through amplification of DNA from these independent $H_2$ producing transformants using vector sequences as primer annealing sites. The hydrogenase coding region from each selected transformant is then sequenced. The coding sequences are further recombined and assayed and/or the transformants are commercially deployed for $H_2$ production. Optionally, another round of annealing-based recombination is performed with the isolated hydrogenase sequences and $H_2$ production is again assayed under conditions of increased Oxygen concentration from the previous round of selection.

EXAMPLE 4

Nucleic acid sequences set forth in SEQ ID NOs: 185–194 are provided. The sequences are recoded to according to the most preferred codons in *E. coli* strain K12, as illustrated in FIG. 13, to generate the nucleic acid sequences set forth in SEQ ID NOs: 330–339. Synthetic oligonucleotides are generated that correspond to 30 to 40 base pair fragments of each sequence. The synthetic oligounucleotides correspond to all nucleotides of each provided sequence such that when all small subunit NiFe-hydrogenase genes (set forth in SEQ ID NOs: 330–334) and large subunit NiFe-hydrogenase genes (set forth in SEQ ID NOs: 335–339) are respectively pooled, all sequences from the original distinct nucleotide sequences are represented in recoded form. In addition, the oligonucleotides are selected such that some sense strand oligonucleotides generated from the recoding of one hydrogenase gene are capable of overlapping with and annealing to antisense strand oligonucleotides generated from the recoding of other hydrogenase genes, as depicted in FIG. 5.

Using methods set forth in U.S. Pat. No. 5,830,721, the oligonucleotides for the small and large subunits are separately recombined in DNA shuffling cycles of denaturation, annealing, and extension. Specifically, the oligonucleotides are resuspended at a concentration of approximately 10–30 ng/µl in PCR reaction mixture containing 0.2 mM each dNTP, 2.2 mM $MgCl_2$, 50 mM KCl, 10 mM Tris-HCl pH 9.0, and 0.1% Triton X-100, 0.3 µl Taq DNA polymerase in a 50 µl reaction volume. The reaction is then put through 45 cycles of reassembly in a thermocycler for one cycle of 94° C. for 60 seconds followed by 45 cycles of 94° C. for 30 seconds, 50° C. for 30 seconds, and 72° C. for 30 seconds, followed by 5 minutes at 72° C. Samples of products of the reaction are analyzed for size using methods previously described in other examples, such as gel electrophoresis.

The library of recombined sequences is cloned into an expression vector containing a promoter capable of expressing the sequences in *E. coli* and at least one marker gene that confers the ability to screen or select for the presence of vector sequences. Such bacterial promoters and selectable markers are known in the art, and are obtained from reagent supply companies such as Invitrogen Inc., Carlsbad, Calif., and Clontech Laboratories, Inc., Palo Alto, Calif. Each vector contains a recoded and recombined small and large subunit NiFe-hydrogenase gene driven by a constitutive or inducible promoter and at least one selectable marker gene.

Independent transformed *E. coli* K12 cells are individually placed in liquid LB media (containing Ni and Fe) in multi-well culture plates and cultured under conditions sufficient for the expression of the recoded and recombined nucleic acid sequences. A selection molecule that corresponds to the selectable maker gene in the vector is also contained in the culture media. The gaseous atmosphere of the culture chamber comprises approximately and 8% Oxygen. Hydrogen production is measured by the placement of a hydrogen detection film on top of the multi-well culture plate that substantially seals the culture wells from the atmosphere in the chamber. After the film has been positioned over the culture wells for 10 minutes, the film is moved to a position adjacent to the culture containers and is photographed on top of a white background. Spots in the film corresponding to each culture well are quantitated using densitometric methods. Cells are removed from wells that correspond to the darkest 5% of all spots on the film and are cultured further. NiFe-hydrogenase sequences are recovered through amplification of DNA from the independent $H_2$ producing transformants using vector sequences as primer annealing sites. The small and large subunit hydrogenase coding regions from each selected transformant are then sequenced. The genes are further recombined and assayed using the same procedure as above, except with 12% Oxygen and/or the transformants are commercially deployed for $H_2$ production Optionally, another round of annealing-based recombination is performed with the isolated hydrogenase sequences and $H_2$ production is again assayed under conditions of increased Oxygen concentration from the previous round of selection.

EXAMPLE 5

Nucleic acid sequences corresponding to SEQ ID NOs: 88–174 are recoded according to the most preferred codons in *Chlamydomonas reinhardtii*, as illustrated in FIG. 4, to generate nucleic acid sequences according to the sequences set forth in SEQ ID NOs: 195–281. Synthetic genes of SEQ ID NOs: 195–281 are created by annealing sense and antisense oligonucleotides followed by ligation and PCR as previously described. The genes are then cloned using standard procedures and maintained in expression vectors known in the art. Using methods set forth in U.S. Pat. No. 6,165,793, the synthetic genes are subjected to PCR using incomplete extension. Clones of SEQ ID NOs: 195–281 are subjected to PCR amplification using primers corresponding to 25 base pair sense and antisense segments dispersed approximately evenly throughout each recoded gene sequence. The clones are resuspended at a concentration of approximately 10–30 ng/µl in PCR reaction mixture containing 0.2 mM each dNTP, 2.2 mM $MgCl_2$, 50 mM KCl, 10 mM Tris-HCl pH 9.0, and 0.1% Triton X-100, 0.3 µl Taq DNA polymerase in a 50 µl reaction volume. The reaction is then put through 100 cycles of incomplete extension reassembly in a thermocycler at 94° C. for 10 seconds and 60° C. for 10 seconds. Products are analyzed using standard methods to determine the size range. Products are preferably 40–80 nucleotides in length and the 60° C. cycle is lengthened or shortened accordingly to obtain the desired fragment size. The products of the incomplete extension reaction are then subjected to a full length primeness PCR reaction of 45 cycles of reassembly in a thermocycler for one cycle of 94° C. for 60 seconds followed by 45 cycles of 94° C. for 30 seconds, 50° C. for 30 seconds, and 72° C. for 30 seconds, followed by 5 minutes at 72° C.

The library of recombined sequences is the cloned into an expression vector and recombined sequences are assayed for the ability to produce $H_2$ according to the culture and assay conditions of EXAMPLE 3.

As alternatives to the above annealing based recombination methods, other annealing based recombination methods based on DNA reassembly and PCR-based interruption methods are employed, such as those set forth in U.S. Pat. Nos. 5,965,408 and 6,440,669.

EXAMPLE 6

Nucleic acid sequences corresponding to SEQ ID NOs: 88–174 are recoded according to the most preferred codons in *C. reinhardtii*, as illustrated in FIG. 4, to generate nucleic acid sequences according to the sequences set forth in SEQ ID NOs: 195–281. Synthetic genes of SEQ ID NOs: 195–281 are created by annealing sense and antisense oligonucleotides followed by ligation and PCR as previously described. The genes are then cloned and maintained in expression vectors using standard techniques.

Using exonuclease-mediated recombination methods set forth in U.S. Pat. No. 6,361,974 and claimed in claims 8–15 of U.S. Pat. No. 6,361,974, multiple copies of parental poly-binding nucleic acid sequences according to SEQ ID NOs: 197 and 204 are prepared. SEQ ID NOs: 197 and 204 are purified from a dam$^+$ E. coli strain, are methylated, and are therefore substrates for DpnI. Nucleic acid sequences according to SEQ ID NOs: 195–281 are amplified by PCR from clones previously referred to in this Example, are unmethylated, and are therefore not substrates for DpnI. Equimolar amounts of each PCR-generated nucleic acid sequence of SEQ ID NOs: 195–281 are pooled and subjected to random fragmentation using a DnaseI, as previously described, to obtain fragments of approximately 30–80 nucleotides. These fragments, referred to as mono-binding nucleic acid strands, are added to full-length fragments of SEQ ID NOs: 197 and 204. The fragments are denatured by heating the sample. The sample is then cooled and the mono-binding fragments are allowed to anneal to the poly-binding fragments. S1 Nuclease is added to the heteromeric polynucleotides to liberate unhybridized segments of mono-binding nucleic acid strands and create exonuclease-treated heteromeric nucleic acid complexes, as depicted in FIG. 4 of U.S. Pat. No. 6,361,974. The population of exonuclease-treated heteromeric nucleic acid complexes is then subjected to extension by a DNA polymerase molecule followed by ligation to achieve a population of poly-binding polynucleotides imperfectly annealed to newly synthesized complementary strands, some portions of which are newly synthesized by DNA polymerase while the other portions originate from mono-binding nucleic acid strands. The parental poly-binding strands are then digested with DpnI and separated from the newly synthesized recombinant complementary strands, leaving only the newly-synthesized recombinant complementary strands. Complementary strands to the newly-synthesized recombinant complementary strands are then generated using N-terminal sense and C-terminal antisense primers that correspond to each end of SEQ ID NOs: 195–281 to create a library of double-stranded, recoded and recombined hydrogenase genes that contain recombined segments of SEQ ID NOs: 195–281. Alternatively random-primed PCR is used to generate the complementary strands.

The recoded and recombined hydrogenase library is then cloned into an expression vector and the sequences are assayed for the ability to produce $H_2$ according to the culture and assay conditions of EXAMPLE 3.

Alternate methods of annealing-based recombination may be employed, such as those described in U.S. Pat. No. 6,361,974 and recited in claims 1–7.

The above examples are not limiting in the sense that a variety of different elements may be substituted in each described method, including the choice of host organism and corresponding recoding key, the culture conditions such as selection of culture media, the choice of vector, selectable marker and promoter, the $H_2$ detection system, the choice of annealing-based recombination method, the choice of which recoded hydrogenase sequences to include in the annealing-based recombination reaction, and other parameters.

SEQUENCE LISTING (377 sequences)

SEQ ID NO: 1 - protein, 574 aa, Clostriduim pasteuranum
MKTIIINGVQFNTDEDTTILKFARDNNIDISALCFLNNCNNDINKCEICTVEVEGTGLVTACDTLIEDGMIINTNSDAVNEKIKSRISQLLDIHEFKCGPCNRRENCEFLKLVIKYKARASKPFLPKDKTEYVDERSKSLTVDRTKCLLCGRCVNACGKNTETYAMKFLNKNGKTIIGAEDEKCFDDTNCLLCGQCIIACPVAALSEKSHMDRVKNALNAPEKHVIVAMAPSVRASIGELFNMGFGVDVTGKIYTALRQLGFDKIFDINFGADMTIMEEATELVQRIENNGPFPMFTSCCPGWVRQAENYYPELLNNLSSAKSPQQIFGTASKTYYPSISGLDPKNVFTVTVMPCTSKKFEADRPQMEKDGLRDIDAVITTRELAKMIKDAKIPFAKLEDSEADPAMGEYSGAGAIFGATGGVMEAALRSAKDFAENAELEDIEYKQVRGLNGIKEAEVEINNNKYNVAVINGASNLFKFMKSGMINEKQYHFIEVMACHGGCVNGGGQPHVNPKDLEKVDIKKVRASVLYNQDEHLSKRKSHENTALVKMYQNYFGKPGEGRAHEILHFKYKK

SEQ ID NO: 2 - protein, 421 aa, Desulfovibrio vulgaris
MSRTVMERIEYEMHTPDPKADPDKLHFVQIDEAKCIGCDTCSQYCPTAAIFGEMGEPHSIPHIEACINCGQCLTHCPENAIYEAQSWVPEVEKKLKDGKVKCIAMPAPAVRYALGDAFGMPVGSVTTGKMLAALQKLGFAHCWDTEFTADVTIWEEGSEFVERLTKKSDMPLPQFTSCCPGWQKYAETYYPELLPHFSTCKSPIGMNGALAKTYGAERMKYDPKQVYTVSIMPCIAKKYEGLRPELKSSGMRDIDATLTTRELAYMIKKAGIDFAKLPDGKRDSLMGESTGGATIFGVTGGVMEAALRFAYEAVTGKKPDSWDFKAVRGLDGIKEATVNVGGTDVKVAVVHGAKRFKQVCDDVKAGKSPYHFIEYMACPGGCVCGGGQPVMPGVLEAMDRTTTRLYAGLKKRLAMASANKA

SEQ ID NO: 3 - protein, 468 aa, Entamoeba histolytica
MPPKPSHTLTGHDHNHSIQFDWSKCMGCGMCATKCTFGVLVKQPPKIPPFVQPNREKLSQENTDKTRVLIDESECTGCGQCSLVCNFGSITPIDHLVDTFKAKEAGKKLVAMIAPSTRLGVAEAMGMPIGSTAMAQLVHCLRLIGFDYVFDVDAGADKTTMDDYAEVIEMKKEGKGPAITSCCPAWIELVEKEYPDLIPNVSTARSPIGCLAGCIKRGWAKDVGIAVEDLYTVGIMPCIAKKTESQRQQIHQDYDASCTSNEIAAYFKKHLPPEECKFTQEREEALAKTEDGQCDLPFRRISGGSNIFGKTGGVCETVLRVIARNAGVDWNSCTVNKEETFKHAASGSTMTNLSVDIGGTIITGAVCHGGYAIRHACELIRKGELKVDVVEMMACVGGCLGGAGQPKIPPAKKLEMDKRRVMLDILDQQTDIRAANENTDVLGWIDKHFDHQGAHQHLHTYFTPRYQN

SEQ ID NO: 4 - protein, 491 aa, Saccharomyces cerevisiae
MSALLSESDLNDFISPALACVKPTQVSGGKKDNVNMNGEYEVSTEPDQLEKVSITLSDCLACSGCITSSEEILLSSQSHSVFLKNWGKLSQQQDKFLVVSVSPQCRLSLAQYYGLTLEAADLCLMNFFQKHFQCKYMVGTEMGRIISISKTVEKIIAHKKQKENTGADRKPLLSAVCPGFLIYTEKTKPQLVPMLLNVKSPQQITGSLIRATFESLAIARESFYHLSLMPCFDKKLEASRPESLDDGIDCVITPREIVTMLQELNLDFKSFLTEDTSLYGRLSPPGWDPRVHWASNLGGTCGGYAYQYVTAVQRLHPGSQMIVLEGRNSDIVEYRLLHDDRIIAAASELSGFRNIQNLVRKLTSGSGSERKRNITALRKRRTGPKANSREMAAATAATADPYHSDYIEVNACPGACMNGGGLLNGEQNSLKRKQLVQTLNKRHGEELAMVDPLTLGPKLEEAAARPLSLEYVFAPVKQAVEKDLVSVGSTW

SEQ ID NO: 5 - protein, 436 aa, Chlorella fusca
MCCPVVASRHAGRARHVAVRAAGPTSECDCPPTPQAKLPHWQQALDELAKPKESRRLMIAQIASAVRVAIAETIGLAPGDVTIGQLVTGLRMLGFDYVFDTLFGADLTIMEEGTELLHRLQDHLEQHPNKEEPLPMFTSCCPGWVAMVEKSNPELIPYLSSCKSPQMMLGAVIKNYYAQQVGVQPSDICNVSVMPCVRKQGEADREWFNTTGAGLARDVDHVVTTAEVGKIFLERGIKLNELPESNFDNPIGEGTGGALLFGTTGGVMEAALRTVYEVVTQKPMGRVDFEEVRGLEGIKEAEITLKPGDDSPFKAFAGADGQGITLKIAVANGLGNAKKLIKSLSEGKAKYDFIEVMACPGGCIGGGGQPRSTDKQILQKRQQAMYNLDERSTIRRSHDNPFIQALYDKFLGAPNSHKAHDLLHTHYVAGGIPEEK

SEQ ID NO: 6 - protein, 574 aa, Clostridium saccharobutylicum
MINIVIDEKTIQVQENTTVIQAALANGIDIPSLCYLNECGNVGKCGVCAVEIEGKNNLALACITKVEEGMVVKTNSEKVQERVKMRVATLLDKHEFKCGPCPRRENCEFLKLVIKTKAKANKPFVVEDKSQYIDIRSKSIVIDRTKCVLCGRCEAACKTKTGTGAISICKSESGRIVQATGGKCFDDTNCLLCGQCVAACPVGALTEKTHVDRVKEALEDPNKHVIVAMAPSIRTSMGELFKLGYGVDVTGKLYASMRALGFDKVFDINFGADMTIMEEATEFIERVKNNGPFPMFTSCCPAWVRQVENYYPEFLENLSSAKSPQQIFGAASKTYYPQISGISAKDVFTVTIMPCTAKKFEADREEMYNEGIKNIDAVLTTRELAKMIKDAKINFANLEDEQADPAMGEYTGAGVIFGATGGVMEAALRTAKDFVEDKDLTDIEYTQIRGLQGIKEATVEIGGENYNVAVINGAANLAEFMNSGKILEKNYHFIEVMACPGGCVNGGGQPHVSAKEREKVDVRTVRASVLYNQDKNLEKRKSHKNTALLNMYYDYMGAPGQGKAHELLHLKYNK

SEQ ID NO: 7 - protein, 421 aa, Desulfovibrio vulgaris
MSRIEMEKIFYEDHAPDPKADPDKLFFIQIDESKCIGCDSCQQYCPTGAIFGDTGDAHKIPHEELCINCGQCLTHCPVGAIYESQSWVTEIEKKIKAKDVKVIAMPAPAVRYALGDAFGLPVGTVTTGKMFSALKELGFDHCWDNEFTADVTIWEEGTEFVQRLTKKLDKPLPQFTSCCPGWHKYVESLYPELFPHMSSCKSPIGMLGTLAKTYGADRMKYDRAKVYTVSIMPCTAKKYEGMRPQLWDSGHKDIDATIDTRELAYMIKKAKIDFTKLPDGKRDTLMGESTGGATLFGVTGGVMEAALRYAYQAVTGKKPESMDFKGVRGLQGVKEATVNVGGVDVKVAVVHGARRFHDVCELVKAGKAPWHFIEFMACPGGCVCGGGQPVMPGVLEAADRRSTRMYAGLKKRLAMASASRA

SEQ ID NO: 8 - protein, 124 aa, Desulfovibrio vulgaris
MQIVNLTRRGFLKAACVVTGGALISIRMTGKAVAAAKQLKDYMMDRINGVYGADAKFPVRASQDNVQVQKLYADFLEKPMSHKAEQLLHTHWVDRSKAIERMKAQGAYPNPRAKEFEGNTYPYE

SEQ ID NO: 9 - protein, 606 aa, Desulfovibrio vulgaris
MNAFINGKEVRCEPGRTILEAARENGHFIPTLCELADIGHAPGTCRVCLVEIWRDKEAGPQIVTSCTTPVEEGMRIFTRTPEVRRMQRLQVELLLADHDHDCAACARHGDCELQDVAQFVGLTGTRHHFPDYARSRTRDVSSPSVVRDMGKCIRCLRCVAVCRNVQGVDALVVTGNGIGTEIGLRHNRSQSASDCVGCGQCTLVCPVGALAGRDDVERVIDYLYDPEIVTVFQFAPAVRVGLGEEFGLPPGSSVEGQVPTALRLLGADVVLDTNFAADLVIMEEGTELLQRLRGGAKLPLFTSCCPGWVNFAEKHLPDILPHVSTTRSPQQCLGALAKTYLARTMNVAPERMRVVSLMPCTAKKEEAARPEFRRDGVRDVDAVLTTREFARLLRREGIDLAGLEPSPCDDPLMGRATGAAVIFGTTGGVMEAALRTVYHVLNGKELAPVELHALRGYENVREAVVPLGEGNGSVKVAVVHGLKAARQMVEAVLAGKADHVFVEVMACPGGCMDGGGQPRSKRAYNPNAQARRAALFSLDAENALRQSHNNPLIGKVYESFLGEPCSNLSHRLLHTRYGDRKSEVAYTMRDIWHEMTLGRRVRGDSD

SEQ ID NO: 10 - protein, 572 aa, Clostridium perfringens
MNKIIINDKTIEFDGDKTILDLARENGFDIPVLCELKNCGNKGQCGVCLVEQEGNDRLLRSCAIKAKDGMVIKTDSEKVLEARKERVAELLDEHEFKCGPCKRRENCEFLKLVIKTKARAHKPFVVADKSEYVDDRSKSIVLDRSKCVKCGRCVAACRTRTATNSIKFHRIDGVRLVGPEELKCFDDTNCLLCGQCIAACPVDALSEKSHIERVQEALNDPEKHVIVAMAPAVRTSMGELFKMGYGQDVTGKLYTALRELGFDKVFDINFGADMTIMEEATELIERIKNNGPFPMLTSCCPSWVREVENYFPELVENLSSAKSPQQIFGAASKTYYPQVADIDPKKVFTVTVMPCTSKKFEADRPEMENEGIRNIDAVITTRELARMIKAAKIDFAKLEDGEVDPAMGEYTGAGVIFGATGGVMEAALRTAKDFMENDNLDNVDYEAVRGLAGIKEAEVEIAGNEYKLAVVSGAANVFELVKSGKINDYHFIEVMACPGGCVNGGGQPHISAEDSDKMDIREVRASVLYNQDKNLEKRKSHQNSALLKMYESYMGKPGHGRAHELLHMKYKK

SEQ ID NO: 11 - protein, 572 aa, Clostridium perfringens
MNKIIINDKTIEFDGDKTILDLARENGFDIPVLCELKNCGNKGQCGVCLVEQEGNDRLLRSCAIKAKDGMVIKTDSEKVLEARKERVAELLDEHEFKCGPCKRRENCEFLKLVIKTKARAHKPFVVADKSEYVDDRSKSIVLDRSKCVKCGRCVAACRTRTATNSIKFHRIDGVRLVGPEELKCFDDTNCLLCGQCIAACPVDALSEKSHIERVQDALNDPEKHVIVAMAPAVRTSMGELFKMGYGQDVTGKLYTALRELGFDKVFDINFGADMTIMEEATELIERIKNNGPFPMLTSCCPSWVREVENYFPELVENLSSAKSPQQIFGAASKTYYPQVADIDPKKVFTVTVMPCTSKKFEADRPEMENEGIRNIDAVITTRELARMIKAAKIDFAKLEDGEVDPAMGEYTGAGVIFGATGGVMEAALRTAKDFMENDNLDNVDYEAVRGLAGIKEAEVEIAGNEYKLAVVSGAANVFELVKSGKINDYHFIEVMACPGGCVNGGGQPHISAEDSDKIDIREVRASVLYNQDKNLEKRKSHQNSALLKMYENYMGKPGHGRAHELLHMKYKK

SEQ ID NO: 12 - protein, 484 aa, Megasphaera elsdenii
MPEFHSRFEKIDRRVPIDEHNCAVQFDVTKCKNCTLCRRACADTQTVLDYYSLSSTGDMPICVHCGQCSSACPFGAIVEVNDVDKVKAALKDPEKIVIFQTAPAVRVGLGEAFGMDPGTFVEGKMVAALRTLGADYVFDTDFGADLTIMEEATELLHRLQSEEIPIPQFTSCCPAWVEFAETFYPDLLQHLSSTKSPISILSPVIKTYFAQQKNIDPKKIVNVCVTPCTAKKAEIRRPELSASGLFWDEPEIRDTDICITTRELAQWIQDENIDFASLEDSKFDKAFGEASGGGRIFGNSGGVMEAAIRTAYHMFTGRPAPKDFIPFEPVRGLQGVKKATVIFGHFVLHVAAISGLGNARAFIDDLIKNDAFEDYSFIEVMACPGGCIGGGGQPKVKLPQVKKVQEARTASIYKSDEETDIKASWQNPEIETLYEAFLDEPLSEMAEFTLHTYFSDKSDQLGRMKNLTPQTNPMSPKYKPPTEE

SEQ ID NO: 13 - protein, 421 aa, Desulfovibrio desulfuricans
MNLVEMEKIQYVDQSPDPRANPDELFFIQIDPEKCIGCDTCQEYCPTGAIFGDTGSAHSIPHEEICINCGQCLTHCPVGAIYEVQSWVRELSEKIKDPEIKVIAMPAPAVRYGLGECFGMPVGTVTTGKMLTALQMLGFDHVWDNEFTADVTIWEEGTEFVNRLTGQIDKPLPQFTSCCPGWHKYVESFYPELFPHLSSCKSPIGMMGALAKTYGPDVMKYDRSKVYTVSIMPCTAKKYEGMRADLWSSGYKDIDATIDTRELAYMIKKAGIDFAALPDGKRDTLMGDSTGGATIFGVSGGVMEAALRYAYEAVTGKKPSSWDFTMVRGLNGIKEGTVTIGDAKINVAVVHGAKRFAEVCEVIKTGKSPWHFIEFMACPGGCVCGGGQPVMPGVLEAMDRKVSRTFAGLKERLNRMSSSKA

SEQ ID NO: 14 - protein, 585 aa, Desulfovibrio fructosovorans
MSMLTITIDGKTTSVPEGSTILDAAKTLDIDIPTLCYLNLEALSINNKAASCRVCVVEVEGRRNLAPSCATPVTDNMVVKTNSLRVLNARRTVLELLLSDHPKDCLVCAKSGECELQTLAERFGIRESPYDGGEMSHYRKDISASIIRDMDKCIMCRRCETMCNTVQTCGVLSGVNRGFTAVVAPAFEMNLADTVCTNCGQCVAVCPTGALVEHEYIWEVVEALANPDKVVIVQTAPAVRAALGEDLGVAPGTSVTGKMAAALRRLGFDHVFDTDFAADLTIMEEGSEFLDRLGKHLAGDTNVKLPILTSCCPGWVKFFEHQFPDMLDVPSTAKSPQQMFGAIAKTYYADLLGIPREKLVVVSVMPCLAKKYECARPEFSVNGNPDVDIVITTRELAKLVKRMNIDFAGLPDEDFDAPLGASTGAAPIFGVTGGVIEAALRTAYELATGETLKKVDFEDVRGMDGVKKAKVKVGDNELVIGVAHGLGNARELLKPCGAGETFHAIEVMACPGGCIGGGGQPYHHGDVELLKKRTQVLYAEDAGKPLRKSHENPYIIELYEKFLGKPLSERSHQLLHTHYFKRQRL

SEQ ID NO: 15 - protein, 421 aa, Desulfovibrio fructosovorans
MSRIEMAKIFYEQTVPPPGTNLDQAYIVQVDETKCIGCDTCMGYCPTGAITGESGEPHKVVDPAACINCGQCLTHCPVAAIYETVSFVPEIEAKLKDKNVKVIAMPAPAVRYALGDPFGMPLGAVTTEHMLTGLKQLGFDNVWDNEFTADVTIWEEGSELLARITKKLDKPLPQFTSCCPGWQKYAETFYPELLPHFSSCKSPIGMMGPLAKTYGAKELGYEPKQIYTVSIMPCTAKKFEGMRPEMDASGFRDIDATINTRELAYMMKKAGIDLPKIANGKRDAVMGESTGGATIFGVSGGVMEAALRFAYQALTKKPPQSWDFKAVRGLNGIKEATINIGGTDVKVAVVNGGKNFAKVCDEVKAGKSPYHFIEFMACPGGCVMGGGQPIMPTVLESMNRTTTKFYASLKKRLALYDAQKA

SEQ ID NO: 16 - protein, 608 aa, Thermotoga maritima
MRRFFKNNLRNLSQNGETNSVRRCFALADVTVVINGRTLTVPDNLTVIEACEKAGIEIPALCHHPRLGESIGACRVCVVEVEGARNLQPACVTKVRDGMVIKTSSDRVKTARKFNLALLLSEHPNDCMTCEANGRCEFQDLIYKYDVEPIFGYGTKEGLVDRSSPAIVRDLSKCIKCQRCVRACSELQGMHIYSMVERGHRTYPGTPFDMPVYETDCIGCGQCAAFCPTGAIVENSAVKVVLEELEKKEKILVVQTAPSVRVAIGEEFGYAPGTISTGQMVAALRRLGFDYVFDTNFGADLTIMEEGSEFLERLEKGDLEDLPMFTSCCPGWVNLVEKVYPELRTRLSSAKSPQGMLSAMVKTYFAEKLGVKPEDIFHVSIMPCTAKKDEALRKQLMVNGVPAVDVVLTTRELGKLIRMKKIPFANLPEEEYDAPLGISTGAAALFGVTGGVMEAALRTAYELKTGKALPKIVFEEVRGLKGVREAEIDLDGKKIRIAVVHGTANVRNLVEKILRREVKYHFVEVMACPGGCIGGGGQPYSRDPEILRKRAEAIYTIDERMTLRKSHENPAIKKLYEEYLEHPLSHKAHELLHTYYEDRSRKKRLAVK

SEQ ID NO: 17 - protein, 645 aa, Thermotoga maritima
MKIYVDGREVIINDNERNLLEALKNVGIEIPNLCYLSEASIYGACRMCLVEINGQITTSCTLKPYEGMKVKTNTPEIYEMRRNILELILATHNRDCTTCDRNGSCKLQKYAEDFGIRKIRFEALKKEHVRDESAPVVRDTSKCILCGDCVRVCEEIQGVGVIEFAKRGFESVVTTAFDTPLIETECVLCGQCVAYCPTGALSIRNDIDKLIEALESDKIVIGMIAPAVRAAIQEEFGIDEDVAMAEKLVSFLKTIGFDKVFDVSFGADLVAYEEAHEFYERLKKGERLPQFTSCCPAWVKHAEHTYPQYLQNLSSVKSPQQALGTVIKKIYARKLGVPEEKIFLVSFMPCTAKKFEAEREEHEGIVDIVLTTRELAQLIKMSRIDINRVEPQPFDRPYGVSSQAGLGFGKAGGVFSCVLSVLNEEIGIEKVDVKSPEDGIRVAEVTLKDGTSFKGAVIYGLGKVKKFLEERKDVEIIEVMACNYGCVGGGGQPYPNDSRIREHRAKVLRDTMGIKSLLTPVENLFLMKLYEEDLKDEHTRHEILHTTYRPRRRYPEKDVEILPVPNGEKRTVKVCLGTSCYTKGSYEILKKLVDYVKENDMEGKIEVLGTFCVENCGASPNVIVDDKIIGGATFEKVLEELSKNG

SEQ ID NO: 18 - protein, 1206 aa, Nyctotherus ovalis
MISRLIAKKAPLFLRTFATSEMISLKIDGKIISVPKGIMLADAIKKAGANVPTMCYHPDLPTSGGICRVCLVESAKSPGYPIISCRTPVEEGMEIVTQGSKMKEYRQANLALMLSRHPNACLSCTSNTNCKTQELSANMNIGQCGFANATPPKNDDSYDMTTAIERDNDKCINCDICVHTCSLQGLNALGFYNEEGHAVKSMGTLDVSECIQCGQCINRCPTGAITEKSEIRPVLDAINIQQRLVFQMAPSIRVAVAEEFGIKPGEKILKNEIATALRKLGSNVFVLDTNFSADLTIIEEGHELIERLYRNVTGKKLLGGDHMPIDLPMLTSCCPGWIMFIEKNYPDLLNNLSTCKSPQGMLGALIKGYWAKNIKKMDPKDIVSVSIMPCTAKKAEKERPQLRGDEGYKDVDYILTTRELAKMLKQSNIDLAKMEPTPFDKVMSEGTGAAVIFGVTGGVMEAALRTANEVITGREVPFKNLNIEAVRGMEGIREAGIKLENVLDKYKAFEGVTVKVAIAHGPNNARKVMDIIKQAKESGKPAPWHFVEVMACPGGCIGGGGQPKPTNLEIRQARTQLTFKEDMDLPLRKSHDNPEIKAIYENYLKEPLGHNSHHYLHTTYSSQKVRDMNLYNANEAAGLDEILAKYPKEKEYLMPIIIEEHDKKGYISDPSIVKISEHLGMYPAQIESILSSYHYFPREHTIAILMSICVHCHNCMMKGQGRLLKTIQETYDIHETHGGVAKDGSFTLHTLNWLGYCVNDAPAMMIKRKGTNYVETFTGLLGDNIDQRLKSLKNLKKELPKWPKNNIREMKSQRNGNSYSCMNTQAPIAEATKKAVSMGPEKVIEEVFKSNLVGRGGAGFRTGKKWESAYKTPASDKYVVCNADEGLPSTYKDWCLLNNEAKRKEVFTGMGICAKTIGAKRCFMYLRYEYRNLVPALEQSIKDVQSTCPELADLKYEIRLGGGPYVAGEENAQFESIEGRAPLPRKDRPGNIFPTMEGLFHKPTVINNVETFFAIPHIIQQGSQSFGEGKMPKLLSVTGDVDEPILIETNLNNYSLNHLLQEISAKDIVAAEIGGCTEPIIFGSKFDTLFGFGRGTLNAVGSVVLFNSSCDLGKIYENKLKFMAEESCKQCVPCRDGSYIFHRAFKELRDTGKSSYNMRALAVASESAARSSICAHGKALESLFKSACDFMNKTKPIYQPHSTYHQ

SEQ ID NO: 19 - protein, 467 aa, Spironucleus barkhanus
MKVRQSPFKIDITNGPIDRNDAIQIDYQKCIGCQMCAKTCTDSQNFNIFKISAPKTKPFVNAYGSVAEGTERNALAGTDCTGCGACVRACPVEALMPAFNIRPVLEPISEKKKVTIAVIAPSTRVGLAEGMGMGVGVTAERQMVYELKQMGFDYVFDNMWGADAPTTEDAKEILKAKAAGKTAFTSCCPAWVKLVETTYPELLPNISSARSPHGIICSVIKKYFAKDIGKKADELYVVGVMPCTAKKNEAARKELTTDGSPDCDISITTRELMAYLKEKKVTFSAAREIELKDNVQAQYDAPFNTFSGSAYIYGKTAGVTEAVVRYVCAIKKVPFSVGMITKELIWENKLHSSSLTLLTFSAAGEDYRICVSYGGLAAHKAVELYKSGELKVDAVEVMVCPGGCVGGGGQPKQPKKDMILKRHEGLDKHDKEAPYSNCTENPTLNEFYERIGTDVHHVMHTTYSAYK

SEQ ID NO: 20 - protein, 468 aa, Trichomonas vaginalis
MLASSATAMKGFANSLRMKDYSSTGINFDMTKCINCQSCVRACTNIAGQNVLKSLTVNGKSVVQTVTGKPLAETNCISCGQCTLGCPKFTIFEADAINPVKEVLTKKNGRIAVCQIAPAIRINMAEALGVPAGTISLGKVVTALKRLGFDYVFDTNFAADMTIVEEATELVQRLSDKNAVLPMFTSCCPAWVNYVEKSDPSLIPYLSSCRSPMSMLSSVIKNVFPKKIGTTADKIYNVAIMPCTRKKDEIQRSQFTMKDGKQETGAVLTSRELAKMIKEAKINFKELPDTPCDNFYSEASGGGAIFCATGGVMEAAVRSAYKFLTKKELAPIDLQDVRGVASGVKLAEVDIAGTKVKVAVAHGIKNAMTLIKKIKSGEEQFKDVKFVEVMACPGGCVVGGGSPKAKTKKAVQARLNATYSIDKSSKHRTSQDNPQLLQLYKESFEGKFGGHVAHHLLHTHYKNRKVNP

SEQ ID NO: 21 - protein, 449 aa, Trichomonas vaginalis
MLASSSRAAANIRWVDTSHNAIAFDMHKCINCQACVRACKNVAGQSVLKSVKINEGKKKGVVQTVTGKLLAETNCIGCGQCTLVCPTQAIHEKDALKQMNNIFKNKGDRILVCQIAPAIRINMRRPWCSSRNSFHRQSRYSPQRLGFDYVFDTNFGADLTIVEEATELLQRLNDPKAVLPMFTSCCPAWVNYVEKSYPQWMPHLSTCRSPIGMLSAVIKNVFPKHIGVDPKRIFSVGIMPCTAKKDEAAREQLMTKSGLHETDLDITSRELAKMIKAAKINFKELPDTELDSPYAMATGGGAIFCATGGVMEAAVRSAYKFATGKELAPIEFVQVRGAEKGIKVGTVDINGREIKVAVAQGVKNAMSLIKKIEEGQDDVKGVVFCEVMACPGGCVGGGGSPRAKTKAAMNKRLDATYRIDRASKYRTPQDNTQLQDLYNATWVVSLVMD

SEQ ID NO: 22 - protein, 589 aa, Trichomonas vaginalis
ASTGINSTANILRNITVTVNGKPLEAKKGETVLELCDRNNIRIPRLCFHPNLPPKASCRVCLVECDGKWLSPACVTTVWDGLKIDTKSKNVRDSVENNLKELLDCHDETCSACIANHRCQFRDMNVAYSVKAETKEICSEEGIDESTNAIRLDTSKCVLCGRCIRACEEVAGTSAIIFGNRAKKMRIQPTFGVTLQETSCIKCGQCTLYCPVGAITEKSQVKEALDILANKGKKITVVQVAPAVRVALSEAFGYKEGTVTTGKMVSALKALGFDLVYDTNYGADLTICEEAGELVNRLRDPNAKFPMFTTCCPAWVNYVEQSAPDFIPNLSSCRSPQGMLSALIKNYLPKLLDVKQEDVLNFSIMPCTAKKDEVERPELRTKSGLKETDMVLTVRELVEMIKLSNIDFNNLPDTQFDNIFGFGSGAGQIFAATGGVMEAASRTAFEVYTGKKLTNVNIYPVRGMDGLRIAELDLDGTKLKVAVCHGIANTAKLLDRLREKDPELMDIKFIEIMACPGGCVCGGGTPQPKNRVSLDNRLAAIYNIDAKMECRKSHENPLIKGVYKEFLGKPNSHLAHELLHTHFKHHPKW

SEQ ID NO: 23 - protein, 582 aa, Trichomonas vaginalis
MKTIILNGNEVHTDKDITILELARENNVDIPTLCFLKDCGNFGKCGVCMVEVEGKGFRAACVAKVEDGMVINTESDEVKERIKKRVSMLLDKHEFKCGQCSRRENCEFLKLVIKTKAKASKPFLPEDKDALVDNRSKAIVIDRSKCVLCGRCVAACKQHTSTCSIQFIKKDGQRAVGTVDDVCLDDSTCLLCGQCVIACPVAALKEKSHIEKVQEALNDPKKHVIVAMAPSVRTAMGELFKMGYGKDVTGKLYTALRMLGFDKVFDINFGADMTIMEEATELLGRVKNNGPFPMFTSCCPAWVRLAQNYHPELLDNLSSAKSPQQIFGTASKTYYPSISGIAPEDVYTVTIMPCNDKKYEADIPFMETNSLRDIDASLTTRELAKMIKDAKIKFADLEDGEVDPAMGTYSGAGAIFGATGGVMEAAIRSAKDFAENKELENVDYTEVRGFKGIKEAEVEIAGNKLNVAVINGASNFFEFMKSGKMNEKQYHFIEVMACPGGCINGGGQPHVNALDRENVDYRKLRASVLYNQDKNVLSKRKSHDNPAIIKMYDSYFGKPGEGLAHKLLHVKYTKDKNVSKHE

SEQ ID NO: 24 - protein, 497 aa, Chlamydomonas reinhardtii
MSALVLKPCAAVSIRGSSCRARQVAPRAPLAASTVRVALATLEAPARRLGNVACAAAAPAAEAPLSHVQQALAELAKPKDDPTRKHVCVQVAPAVRVAIAETLGLAPGATTPKQLAEGLRRLGFDEVFDTLFGADLTIMEEGSELLHRLTEHLEAHPHSDEPLPMFTSCCPGWIAMLEKSYPDLIPYVSSCKSPQMMLAAMVKSYLAEKKGIAPKDMVMVSIMPCTRKQSEADRDWFCVDADPTLRQLDHVITTVELGNIFKERGINLAELPEGEWDNPMGVGSGAGVLFGTTGGVMEAALRTAYELFTGTPLPRLSLSEVRGMDGIKETNITMVPAPGSKFEELLKHRAAARAEAAAHGTPGPLAWDGGAGFTSEDGRGGITLRVAVANGLGNAKKLITKMQAGEAKYDFVEIMACPAGCVGGGGQPRSTDKAITQKRQAALYNLDEKSTLRRSHENPSIRELYDTYLGEPLGHKAHELLHTHYVAGGVEEKDEKK

SEQ ID NO: 25 - protein, 415 aa, Chlorella fusca
AGPTSECDCPPTPQAKLPHWQQALDELAKPKESRRLMIAQIASAVRVAIAETIGLAPGDVTIGQLVTGLRMLGFDYVFDTLFGADLTIMEEGTELLHRLQDHLEQHPNKEEPLPMFTSCCPGWVAMVEKSNPELIPYLSSCKSPQMMLGAVIKNYYAQQVGVQPSDICNVSVMPCVRKQGEADREWFNTTGAGLARDVDHVVTTAEVGKIFLERGIKLNELPESNFDNPIGEGTGGALLFGTTGGVMEAALRTVYEVVTQKPMGRVDFEEVRGLEGIKEAEITLKPGDDSPFKAFAGADGQGITLKIAVANGLGNAKKLIKSLSEGKAKYDFIEVMACPGGCIGGGGQPRSTDKQILQKRQQAMYNLDERSTIRRSHDNPFIQALYDKFLGAPNSHKAHDLLHTHYVAGGIPEEK

SEQ ID NO: 26 - protein, 505 aa, Chlamydomonas reinhardtii
MALGLLAELRAGQAVACARRTNAPAHPAAVVPCLPSRAGKFFNLSQKVPSSQSARGSTIRVAATATDAVPHWKLALEELDKPKDGGRKVLIAQVAPAVRVAIAESFGLAPGAVSPGKLATGLRALGFDQVFDTLFAADLTIMEEGTELLHRLKEHLEAHPHSDEPLPMFTSCCPGWVAMMEKSYPELIPFVSSCKSPQMMMGAMVKTYLSEKQGIPAKDIVMVSVMPCVRKQGEADREWFCVSEPGVRDVDHVITTAELGNIFKERGINLPELPDSDWDQPLGLGSGAGVLFGTTGGVMEAALRTAYEIVTKEPLPRLNLSEVRGLDGIKEASVTLVPAPGSKFAELVAERLAHKVEEAAAAEAAAAVEGAVKPPIAYDGGQGFSTDDGKGGLKLRVAVANGLGNAKKLIGKMVSGEAKYDFVEIMACPAGCVGGGGQPRSTDKQITQKRQAALYDLDERNTLRRSHENEAVNQLYKEFLGEPLSHRAHELLHTHYVPGGAEADA

SEQ ID NO: 27 - protein, 403 aa, Scenedesmus obliquus
PHWQQTLDELAKPKERKVMIAQIAPAVRGIAETMGLNPGDVTVGQMVTGLRMLGFDYVFDTLFGADLTIMEEGTELLHRLQDHLEQHPNKEEPLPMFTSCCPGWVAMVEKSNPELIPYLSSCKSPQMMLGAVIKNYFAAEAGAKPEDICNVSVMPCVRKSGEAEPRSGSTHHRAGRRDVDHVMTTAELGKIFVERGIKLNELQESPFDNPVGEGSGGGLLFGTTGGVMEAALRTVYEVVTAEALGPQRSSLTTSTAWTPAQRASPRPSPQAPTAPSRPLQAQTESGITLNIAVANGLGNAKKLIKQLAAGESKYDFTEVMACPGGCIGGGGQPQRNKQILQKRQAAMYDLDERAVIRRTENPLIGALYEKFLGEPNGHKAHELLHTHYVAGGVPDRRSEGEAW

SEQ ID NO: 28 - protein, 581 aa, Thermoanaerobacter tengcongensis
MDKVRVTIDGITVEVPSYYTVLEAAKEAGIDIPTLCYLKEINQIGACRICLVEIEGVRNLQTSCTYPVFDGMKVYTNTPKIREARRLNLELILSNHDRNCLTCVRSTNCELQALAKRLGVEEIRFEGENIKYPIDDASPAVVRDPNKCVLCRRCVAVCSEVQNVFAIGMVNRGFKTMVAPSFGRSLKDSPCISCGQCIMVCPVGAIYEKDHTKRVYEALADDKKYVVAQTAPAVRVALGEEFGMPVGTIVTGKMAAALRRMGFDAVFDTNFAADLTIMEEGSELLERIKHGGKLPMITSCSPGWIAFCEKYYPEFIDNLSTCKSPHMMMGALVKSYYAEKKGLDPKDIFVVSIMPCTAKKLEIEREEMIRNGMKDVDAVLTTRELARMIKEMGIDFVNLKDEEFDEPLGMSTGAGAIFGATGGVMEAALRTVAEIVEGRDIGKIDFEEVRGLEGVREATITIDGMDIKIAIANGTGNAKKLLDKVKAGEVEYHFIEVMGCPGGCIMGGGQPIHNPNEMEEVKKLRAKAIYEIDKNLPIRKSHENPAIKRLYEEFLGYPLSEKSHELLHTHYSRKELYPLVK

SEQ ID NO: 29 - protein, 636 aa, Neocallimastix frontalis
MSMLSSVLNKAVVNPKLTRSLATAAAEKMVNISINGRKFQVKPKTTVLEAAKANGYYIPTLCYHQELPVAGNCRLCLVYAKGSWKPLTACTTEVWEGMEIETDSPAVIETVRSSLSMMREEHPNDCMTCGSNGDCEFQDLIYRYQIDAKHPVRSLLKHKSKKTNHSITEPCYSPFDNTTFSVARDMNKCVKCGRCIRACHHFQNINILGFINRAGYERVGTPMDRPMNFTKCVECGQCSQVCPVGAITARTEVVDVLRHLDTKRKVVVCSTAPAIRVAPAEEFSTEADFDFTGKMVAGLRKLGFDYIFDTNFSADLTIMEEGTELIDRLNNGGKFPMFTSCCPGWINMVEKSYPELSDNLSSCKSPQQMIGAVIKSYFAKKLGLSTEDIIHVSIMPCTAKKGEARRPEFVQKGKDGKDYPDIDYVITTRELLTLLKLKKINPAELPDDKFDSPLGIGSSAGNLFGVTGGVMEAAIRTAQVITGVENPIPLGELKAIRGLDGIKAANVPLKTKDGKEVSVRAAVVSGGANIQKFLEKIKNKELEFDFIEMMMCPGGCINGGGQPKSADPEIVAKKMQRMYTMDDQAKLRLCHENPEIIDVYKNFLGEPNSHLAHELLHTHYNDRSKTIHDMGHHEKK

SEQ ID NO: 30 - protein, 555 aa, Piromyces sp. E2
CLVDVKGSWKPLTACTTEVWEGMEIETDTPAVRETVRSSLAMMREEHPNDCMTCESNGNCEFQDLIYRYQIDAQHPVRTLLRNKFKKTNHSITEPCYSPFDDSTFSISRDMNKCVKCGRCVRACHHFQNINILGFINRAGYERVGTPMDRPMNFTKCVECGQCSQVCPVGAITERNECIEVLRHLDTKRKIVVVSTAPAIRVALAEEFNAEPDFDFTGKMVAGLKKLGFDYIFDTNFSADLTIMEEGTELITRLNEGGKFPMFTSCCPGWINMVEKSYPEIRDNLSSCKSPQQMIGAVIKTYFAKKINAKPEDIIHVSVMPCTAKKGEAKRPEFKRDGVPDIDHVITTRELITLLKLKRINPSELKNEKFDSPLGIGSSAGNLFGVTGGVMEAAVRTAQIITGVENPIPLGELKAIRGLDGIKAASVPLKTKDGKDVNVRAAVVSGGANIQKFLEKLKKKELEFDFVEMMMCPGGCINGGGQPKSADPKVVAKKMERMYTMDDQASLRLSHENPEITQIYKEFLKEPNGHLSHELLHTHYNDRSKAIQDMSLHQK

SEQ ID NO: 31 - protein, 389 aa, Neocallimastix frontalis
TERNEVIEVLRQLDSKRKILVCSTAPAIRVALAEEFNADPDFNFTGKMVAGLRKLGFDYIFDTNFSADLTIMEEGTELINRLNNGGKFPMFTSCCPGWINMVEKSYPELRENLSTCKSPQQMIGALIKSYFAKKLGVSTEDIIHVSVMPCTAKKGEAKRPEFVQKGKDGKNYPDIDYVLTTRELLTLMKLKKVNPAELADDKLDSPLGISSSAGNLFGVTGGVMEAAVRTAQIITGVENPIPLGELKAVRGLEGIKAATVPLKTKEGKDINVRAAVVSGGANIQKFLEKIKNKEVEFDFVEMMMCPGGCINGGGQPKSADPKIVTKKMQRMYTMDEQATLRLSHENEEVKQIYKEFLIEPNGHLSHELLHTHYNDRSKAIQDMSLHEKK

SEQ ID NO: 32 - protein, 458 aa, Desulfovibrio desulfuricans
MNGQQNVIRIDSDICTGCGRCKDVCPVGAVEGVQGTPHSIREDVCVLCGQCVQQCSAFASFYEQHPACIAEKKRERGLFVSEAAPLFAAWHTGDAPRVAGRLAEGCHSMVQCAPAVRAAIGEEFGMPAGALTPGRLAAALRRLGFDRVYDTNFAADLTIMEEGSELLQRMEGAGPLPMFTSCCPAWVRYAEQQFPDLLEHLSSCKSPQQMAGAVFKSYGAQLDGVDPRQVFSVAVMPCTCKKAEAQRPGMEHDGVRDVDAVLTTGELAAMLRQAHIDFAALPDEPFDRPLGSYSGAGNIFGLTGGVMEAALRTAYELVTGEPVPCTELVYVRGGEGIRHATLTMDGRTFRVAVVAGLQHVRPLLEAVRAGTCDVNFVEVMCCPQGCISGGGQPKVLLPFQRDEVYAARKAALYRHDAELACRKSHENPQVQALYREFLGEPLSHVSHNLLHTVYGQTR

SEQ ID NO: 33 - protein, 554 aa, Desulfitobacterium hafniense
MMQLKHPFQSGFQQQSCKRHTKKVVVDMESKAGKGSNLSRRSFLKFAGGAGIAGASLSLTGCGQPLTPASAVGGEGWMPTQYNEPGGWPTNVRGRVPIDPENPALRRDDQKCILCGQCIEVCKTIQSVYGNYELPLKNEIPCINCGQCIHWCPSGAISEREDIDQVAKALADPKITVVVQTAPATRIGLGEEFGLPVGTNVQGKQVAALRKLGFDVIFDTNFAADLTIMEEGTELVKRITGELHHPLPQFTSCCPGWVKFVEYYYPELLPNLSSAKSPQQMAGALVKTYFAEKNHVEPQKIFSVAIMPCTAKKFECQRPEMISAQTYWQDEQVSPDVDVVLTTRELARMIKRAGIDLPSLPDEEYDQLMGVATGAGAIFGTTGGVMEAAVRSAYYLVTGEQPPAALWQLTPVRGMEGVKEAAVSIPGAGEIRIAVISGLDNARAIMEQVKAGNSPWTFIEVMACPGGCQYGGGQPRSSAPPSDGVRNTRAASLYKIDAQAKLRNSHDNPQIKQVYAEFLTSPLSEKAEELLHTHYISRAEEFDAKKPQSHEYEV

SEQ ID NO: 34 - protein, 578 aa, Eubacterium acidaminophilum
MVNITIDGRQVTVPANSTVLDAARDMGINIPTLCYLKDINKTGACRMCLVEVEGIRNLQTACTFPVRDGLVVKTNTKRVRDARRDNLQLILSNHHRDCLSCFRNGSCELQALCDDMGLSELDFEAPKELKPVDMLSHSIVRDPNKCILCGRCVAVCNKVQEVGILAFTNRGVETEVAPAFATSMADAPCIYCGQCVNVCPVAALREKTDIEKVWEVLEDETKHVVVQVAPAVRAALGEMFGNPIGTRVTGKMFTALKMLGFQKVFDTNFAADLTIMEEGTELLGRIKNGGTLPMITSCSPGWIRYVEHFYPELLDHVSSCKSPQQMMGAVLKSYYAEKNNIAPENMIVVSVMPCIAKKTESAKEEMKNVHGTRDVDIVLTTRELGKMIKEARIEFNDLQDSNPDEFFGDYTGAAVIFGATGGVMEAAIRTVADIVSGQELEDIEYTAVRGLEGIKEAAVKIGDLEVKVAVAHGTANAGKLMDLVRDGKADYHFIEIMGCSGGCVTGGGQPHVDSRTKEKVNVKLERAKALYTEDKLRDKRKSHHNESVKRLYEEYLGKPNGHKAHELLHTHYKKRELF

SEQ ID NO: 35 - protein, 619 aa, Rhodopseudomonas palustris
MCTPDQASLSARDPAEATITLSINGVACAGFANETILSCARRYDVYIPTLCELEDIDHTPGACRVCLVEILQAGKDTPQIVTACNTPVRDGMEVQTRSKKARDMQRLQVELLMADHLQDCATCIRHGSCELQDLAQFVGLQQNRFFDRERTEARPVDHSSPSMVRDMRRCVRCQRCVAICRYHQKIDALAIEGSGLERMVALRDADGYPNSVCVSCGQCVLVCPTGALGERDETDRALDYICDPNVVTVVQFAPAVRVAFGEEFGLPAGTNVEGQIIAACRKLGVDVVLDTNFAADVVIMEEGAELLARLKQGRRPTFTSCCPAWINFAEIHYPDVLPLLSSTKSPQQVLSTIAKSYLPAQLGVPAERIRVISIMPCIAKKDEAVRPQMVHDGQPETDLVLTTREFARLLRREGIDLKDLPSSQFDRPFLSAYSGAGAIFGTTGGVMEAAVRTIYALVNGRELERIELTQLRGFEGLREATVDLGAPVGEVKVAMVHGLGDTRKLVESVLSGEANYDFIEVMACPGGCVDGGGSLRSKKAYLPLALKRRETIYNVDRAAKVRQSHNNPQVQALYRELLQAPNSEIAHRLLHTHYASRKRELQHTVKEIWDDLTMSTILY

SEQ ID NO: 36 - protein, 644 aa, Clostridium thermocellum
MDSFLMKGYIKEANIDYSCSRGSMEDLPKWEFREIPKVPRAVMPSLSLEERKNNFNEVELGLSEEVARKEARRCLKCGCSARFTCDLRKEASNHGIVYEEPIHDRPYIPKVDDHPFIVRDHNKCISCGRCIAACAEIEGPGVLTFYMKNGRQLVGTKSGLPLRDTDCVSCGQCVTACPCAALDYRRERGKVVRAINDPKKTVVGFVAPAVRSLISNTFGVSYEEASPFMAGLLKKLGFDKVFDFTFAADLTIVEETTEFLSRIQNKGVMPQFTSCCPGWINFVEKRYPEIIPHLSTCKSPQMMMGATVKNHYAKLMGINKEDLFVVSIVPCLAKKYEAARPEFIHDGIRDVDAVLTTTEMLEMMELADIKPSEVVPQEFDEPYKQVSGAGILFGASGGVAEAALRMAVEKLTGKVLTDHLEFEEIRGFEGVKESTIDVNGTKVRVAVVSGLKNAEPIIEKILNGVDVGYDLIEVMACPGGCICGAGHPVPEKIDSLEKRQQVLVNIDKVSKYRKSQENPDILRLYNEFYGEPNSPLAHELLHTHYTPKHGDSTCSPERKKGTAAFDVQEFTICMCESCMEKGAENLYNDLSSKIRLFKMDPFVQIKRIRLKETHPGKGVYIALNGKQIEEPMLSGNIPDESESE

SEQ ID NO: 37 - protein, 572 aa, Clostridium perfringens; identical to SEQ ID NO: 10

SEQ ID NO: 38 - protein, 583 aa, Clostridium thermocellum
MHVLKLVHSTQYWRAEEMDNREYMLIDGIPVEINGEKNLLELIRKAGIKLPTFCYHSELSVYGACRMCMVENEWGGLDAACSTPPRAGMSIKTNTERLQKYRKMILELLLANHCRDCTTCNNNGKCKLQDLAMRYNISHIRFPNTASNPDVDDSSLCITRDRSKCILCGDCVRVCNEVQNVGAIDFAYRGSKMTISTVFDKPIFESNCVGCGQCALACPTGAIVVKDDTQKVWKEIYDKNTRVSVQIAPAVRVALGKELGLNDGENAIGKIVAALRRMGFDDIFDTSTGADLTVLEESAELLRRIREGKNDMPLFTSCCPAWVNYCEKFYPELLPHVSTCRSPMQMFASIIKEEYSTSSKRLVHVAVMPCTAKKFEAARKEFKVNGVPNVDYVLTTQELVRMIKESGIVFSELEPEAIDMPFGTYTGAGVIFGVSGGVTEAVLRRVVSDKSPTSFRSLAYTGVRGMNGVKEASVMYGDRKLKVAVVSGLKNAGDLIERIKAGEHYDLVEVMACPGGCINGGGQPFVQSEEREKRGKGLYSADKLCNIKSSEENPLMMTLYKGILKGRVHELLHVDYASKKEAK

SEQ ID NO: 39 - protein, 439 aa, Desulfovibrio desulfuricans
MAGCKAQHPPAAYLAGLEVPAAGSEVTMEGVRYKMNAPKDVDPATIRFVEVDHDKCMACGECEYHCPTGVMQEVTEDGYRGVVDPVACVNCGQCLANCPFGAIHEEVSFVGELYEKLKDPDTVVVSMPAPAVRYALGECFGLPTGTYVGGQMHAALRRLGFNLVWDTEWTADVTIMEEGTELLERVKHGNMPLPQFTSCCPGWIKFAETFYPDLEKHLSTCKSPIAMIGPLAKTYGAQEAGVPAKKMYTVSIMPCIAKKFEGMRPEMNASGYRDIDATITTRELAWMIKKAGIDFTSLPSEEPDPALGMSTGAATIFCTSGGVMEAALRLAYEALSGGTLADPDIKVVRTHEGINTAEVPVPNFGTVKVAVASGLDNAAKLCEEVRAGKSPYHFIEVMTCPGGCVNGGGQPLEPGMLQSSLFKSTITKINRRFTRRSVA

SEQ ID NO: 40 - protein, 379 aa, Desulfovibrio desulfuricans
MNLVEMEKIQYVDQSPDPRANPDELFFIQIDPEKCIGCDTCQEYCPTGAIFGDTGSAHSIPHEEICINCGQCLTHCPVGAIYEVQSWVRELSEKIKDPEIKVIAMPAPAVRYGLGECFGMPVGTVTTGKMLTALQMLGFDHVWDNEFTADVTIWEEGTEFVKRLTGQIDKPLPQFTSCCPGWHKYVESFYPELFPHLSSCKSPIGMMGALAKTYGPDVMKYDRSKVYTVSIMPCTAKKYEGMRADLWSSGYKDIDATIDTRELAYMIKKAGIDFAALPDGKRDTLMGDSTGGATIFGVSGGVMEAALRYAYEAVTGKKPSSWDFTMVRGLNGIKEGTVTIGDAKINVAVVHGAKRFAEVCEVIKTGKSPCISSSLCLPR

SEQ ID NO: 41 - protein, 421 aa, Desulfovibrio desulfuricans
MNLVEMEKIQYVDQSPDPRANPDELFFIQIDPEKCIGCDTCQEYCPTGAIFGDTGSAHSIPHEEICINCGQCLTHCPVGAIYEVQSWVRELSEKIKDPEIKVIAMPAPAVRYGLGECFGMPVGTVTTGKMLTALQMLGFDHVWDNEFTADVTIWEEGTEFVKRLTGQIDKPLPQFTSCCPGWHKYVESFYPELFPHLSSCKSPIGMMGALAKTYGPDVMKYDRSKVYTVSIMPCTAKKYEGMRADLWSSGYKDIDATIDTRELAYMIKKAGIDFAALPDGKRDTLMGDSTGGATIFGVSGGVMEAALRYAYEAVTGKKPSSWDFTMVRGLNGIKEGTVTIGDAKINVAVVHGAKRFAEVCEVIKTGKSPWHFIEFMACPGGCVCGGGQPVMPGVLEAMDRKVSRTFAGLKERLNRMSSSKA

SEQ ID NO: 42 - protein, 369 aa, Trichomonas vaginalis
CDGKWLSPACVTTVWDGLKIDTKSKNVRDSVENNLKELLDCHDETCSACIANHRCQFRDMNVAYSVKAETKEICSEEGIDESTNAIRLDTSKCVLCGRCIRACEEVAGTSAIIFGNRAKKMRIQPTFGVTLQETSCIKCGQCTLYCPVGAITEKSQVKEALDILANKGKKITVVQVAPAVRVALSEAFGYKEGTVTTGKMVSALKALGFDLVYDTNYGADLTICEEAGELVNRLRDPNAKFPMFTSCCPAWVNYVEQSAPDFIPNLSSCRSPQGMLSALIKNYLPKLLDVKQEDVLNFSIMPCTAKKDEVERPELRTKSGPKETDMVLTVRELVEMIKLSNIDFNNLPDTQFDNIFGFGSGAGQIFAAT

SEQ ID NO: 43 - protein, 369 aa, Trichomonas gallinae
CDGKWLSPACVTTVWDGLRIDTKSKVVRDSVENNLKELLDCHDETCSSCVANHRCQFRDMNVAYSVKADTKEICSEEGIDESTHAIRLDTSKCVLCGRCIRACEEVAGTSAIIFGNRAKHMRIQPTFGGTLQETACIKCGQCTLYCPVGAITEKSQVKEALDILANKGKKVTVVQVAPAVRVALSEAFGYKEGTVTTGKMVSALKALGFDLVYDTNYGADLTICEEAGELVNRLKDPKAVFPMFTSCCPAWVNYVEQSAPDFIPNLSSCRSPQGMLSSLIKNYLPKLLGIKQEEVMNFSIMPCTAKKDEIERPELQTKTGLKETDMVLTVRELVEMIKLSNIDFNNLPDTPFDNIFGFGSGAGQIFAAT

SEQ ID NO: 44 - protein, 456 aa, Nyctotherus ovalis
MISRLIAKKAPLFLRTFATSEMISLKIDGKIISVPKGIMLADAIKKAGANVPTMCYHPDLPTSGGICRVCLVESAKSPGYPIISCRTPVEEGMEIVTQGSKMKEYRQANLALMLSRHPNACLSCTSNTNCKTQELSANMNIGQCGFANATPPKNDDSYDMTTAIERDNDKCINCDICVHTCSLQGLNALGFYNEEGHAVKSMGTLDVSECIQCGQCINRCPTGAITEKSEIRPVLDAINIQQRLVFQMAPSIRVAVAEEFGIKPGEKILKNEIATALRKLGSNVFVLDTNFSADLTIIEEGHELIERLYRNVTGKKLLGGDHMPIDLPMLTSCCPGWIMFIEKNYPDLLNNLSTCKSPQGMLGALIKGYWAKNIKKMDPKDIVSVSIMPCTAKKAEKERPQLRGDEGYKDVDYILTTRELAKMLKQSNIDLAKMEPTPFDKVMSEGTGAAVIFGVT

SEQ ID NO: 45 - protein, 369 aa, Trichomonas vaginalis
CDGKWLAPACVTTVWDGLKIDTKSKMVKESVENNLKELLDCHDETCSSCVANHRCQFRDMNVAYSIKAETKEECSEEGIDESTNSIRLDTSKCVLCGRCIRACEEVAGQSAIIFGNRAKHMRIQPTFGQTLQDTSCIKCGQCTLYCPVGAITEKSQVKQALDILSNKGKKISVIQVAPAVRVALSEAFGYKEGSVTTGKMVSALKALGFDYVYDTNYSADLTIVEEAGELVQRLKNPNAVFPMFTSCCPAWVNYVEQSAPDFIPNLSSCRSPQGMLSSLVKNYLPKVLNIPVEDVLNFSIMPCTAKKDEIERPELRTKDGHKETDMVLTVRELVEMIKLSGIDFNNLPDTPFDSIFGFGSGAGQIFAAT

SEQ ID NO: 46 - protein, 464 aa, Entamoeba histolytica
RLHTVTGHDHNHSIQFDWSKCMGCGMCATKCTFGVLVKQPPKIPPFVQPNREKLSQENTDKTRVLIDESECTGCGQCSLVCNFGSITPIDHLVDTFKAKEAGKKLVAMIAPSTRLGVAEAMGMPIGSTAMAQLVHCLRLIGFDYVFDVDAGADKTTMDDYAEVIEMKKEGKGPAITSCCPAWIELVEKEYPDLIPNVSTARSPIGCLAGCIKRGWAKDVGIAVEDLYTVGIMPCIAKKTESQRQQIHQDYDASCTSNEIAAYFKKHLPPEECKFTQEREEALAKTEDGQCDLPFRRISGGSNIFGRTGGVCETVLRVIARNAGVDWNSCTVNKEETFKHAASGSTMTNLSVDIGGTIITGAVCHGGYAIRHACELIRKGELKVDVVEMMACVGGCLGGAGQPKIPPAKKLEMDKRRVMLDILDQQTDIRAANENTDVLGWIDKHFDHQGAHQHLHTYFTPRYQN

SEQ ID NO: 47 - protein, 474 aa, Giardia intestinalis
MPPKPQHDVTGVDSNNAIMIDYAKCIGCNMCIKACDVQGIGVYKQNEKPKYPPIVKLSTLFNSDCIGCGQCATICPVDAIAPKNNLEIYKGESASKKVRVALIAPSTRVAFGDVFGLPIGTNTIYSLIRMLKQYLGFDYVFDVNFGADETTVIDTQELLHFKHEGRGPVFTSCCPAWVNLCEMKYPELLPQVSTAKSCVAMVATLVKRRWVQEHLIPKGIVDSVDDVYVADIMPCTAKKDESMRPQLNRDVDICLTVREVAEHLYFLHGARLTLEEVEADALVLRPGRSTQKKWDFDAPFNTVSGGSHIFGKTGGVAETCLRFISYMKKSPIENVKEELLKEFKTPGQLVQTVKLVSCEIAGETYRALIAHGGSAINAAARMVLNKEVECDVVEQMACPGGCQNGGGMPKIKGKKEAVLTRASTLDILDGKERFASAGENKTLWGFNGCLTEHEAHELLHTHYQHRPVESLLPQ

SEQ ID NO: 48 - protein, 844 aa, Desulfitobacterium hafniense
MVKIISITNNAKRQGKGTSRKEKQAMKEVTKQQRIRVTVNGRQMEVYGDLTILQALLQEDIHIPHLCYDIRLERSNGNCGLCVVELGEGSEQQDVKACHTPIQEGMIIHTNSPRLEHYRKIRLEQILADHNADCVAPCVMTCPANIDIQSYLSHAGNGNFETAIKVIKERNPFPIVCGRVCPHSCEAQCRRNLIDEPVAINHVKRFIADWDIAHEQPWAPRKKAATGKKIAVVGAGSSGLSAAYYSAIQGHDVTVFERHPRAGGMMRYGIPEYRLPKETLDREIGLIADLGVKIMTNKALGTHIRLEDLHQDFDAVYLAIGSWRATPLQIEGDNLEGVWLGINFLEQVTKGADIKLGEHVVVIGGGNTAIDCARTALRKGAGSVKLVYRRTREEMPAESYEVEEAIHEGVEMYFLTAPHKIVAEGGRKLLHCIKMTLGEPDRSGRRRPIPIEGSETAFEADTIIGAIGQSTNTQFLYHDLPVKLNKWGDIEINGKTMQTSEMNIFAGGDCVTGPATVIQAVAAGRHAAEAMDSFLMKGYVKEQPMDYSCSRGSLEDLPQWEFEKIPRLKRAPMPALPPAERRDNFREVETGLSEETARAEARRCLKCGCYERYDCDLRQEASLHHVEFKKPVHERPYIPIVEDHSIIIRDHNKCISCGRCIAACAEVEGPDILSFYMKHGRQLVGTKSGLPLDQTDCVSCGQCVNACPCGALDYRSEIGRVFRAINDPGKTTVAFVAPAVRSVVSSQYGVSYQEASRFIAGLLKKIGFDKVFDFTFAADLTIVEETTEFLTRLQSHKPIPQFTSCCPGWVNFVERRYPEIIPYLSSCKSPQMMMGATVKITLRN

SEQ ID NO: 49 - protein, 119 aa, Nyctotherus velox
ILFMEKNYPDMLNHLSTCKSPQGMLGALIKGYWAKNVKKIDPKDVVSVSIMPCTAKKEEKDRITLKSDEGYNNVDYVLTTRELAKMFKQSNIDPSKLPPTQFDNVMSEGTGAAVIFGVT

SEQ ID NO: 50 - protein, 476 aa, Oryza sativa
MASSSSSASSRFSPALQASDLNDFIAPSQDCIISLNKGPSARRLPIKQKEIAVSTNPPEEAVKISLKDCLACSGCITSAETVMLEKQSLGDFITRINSDKAVIVSVSPQSRASLAAFFGLSQSQVFRKLTALFKSMGVKAVYDTSSSRDLSLIEACSEFVTRYHQNQLSSGKEAGKNLPMLSSACPGWICYAEKTLGSFILPYISAVKSPQQAIGAAIKHHMVGKLGLKPHDVYHVTVMPCYDKKLEAVRDDFVFSVEDKDVTEVDSVLTTGEVLDLIQSRSVDFKTLEESPMDRLLTNVDDDGQLYGVSGGSGGYAETVFRHAAHVLFDRKIEGSVDFRILRNSDFREVTLEVEGKPVLKFALCYGFRNLQNIIRKIKMGKCEYHFIEVMACPSGCLNGGGQIKPAKGQSAKDLIQLLEDVYIQDVSVSNPFENPIAKRLYDEWLGQPGSENAKKYLHTKYHPVVKSVASQLQNW

SEQ ID NO: 51 - protein, 114 aa, Psalteriomonas lanterna
INLVEKHYPEYLPNLSSCRSPQGMLSSLIKNYWAKKMGIEPKDVVVVSFMPCGAKKDEIKRPQLKGETDYVLTTRELGKLFKMGGLNDLSVLEPVKYDDPLGESTGAAVIFGAT

SEQ ID NO: 52 - protein, 119 aa, Nyctotherus ovalis
IMFMEKNYPDMLNHLSTCKSPQGMLGALIKGYWAKNIKKMDPKDIVSVSIMPCTAKKAEKERPQLRGDEGYKDVDYILTTRELAKMLKQSNIDLGKMEPTPFDKVMSEGTGAAVIFGVT

SEQ ID NO: 53 - protein, 119 aa, Nyctotherus ovalis
IMFMEKNYPDMLNHLSTCKSPQGMLGALIKGYWAKNVKKMDPKDIVSVSIMPCTAKKAEKERPQLRGDEGYKDVDYILTTRELAKMLKQSNIDLGKMEPRPFDKVMSEGTGAAVIFGVT

SEQ ID NO: 54 - protein, 520 aa, Rhodospirillum rubrum
MRPVQRPRRWPGLRQRLSPERPVDRRSRRRSGAARPGRRRGSGVQHEILRSVSQRDMSMSIQPTVTIDPELCTGCGRCVETCPVQAIAGSRGKAHEIEAAACVSCGRCVATCAAFDSIFDAFPTPRPVRLKRRGLPGSLKEPLFAAHDPSRIEAVRKAFATPKRMTVMQVDTMACVALAEDFGLPPGSLSPLKIASAARQLGFDRVYRTSFPAGLAVLETAHEMAARLANGGNLPVINSSCPAVVAFLERRYPELLHYLSTVKSPHQIAGALYNSYLADAANLAPANIHKVSVVACLSHKAEAERPEMMTCGCPDIDTVLTARELAILIKDAGIDVPLLGDGEFDNDFPEIEGLDTLYCAPGDVSRAVLGAGRWFLGQGEGVGAPAGETVEVLDEATRLTRLAYPGGTLQALTVAGFDKAVPYLEAIKAGRNAFQFLEIASCPQGCASGAGLPKVLLETEKPARYRARIENLPPAAPEAWSRLPGHPSIVALYGGYFGKAIGDKSNRRLHTQYAEPAAAP

SEQ ID NO: 55 - protein, 240 aa, Desulfitobacterium hafniense
MAVEKLTGEVLTDQLDYQEVRGLQGIKEAAVEAKGKKVNVAVISGLHNVEPILEKIIEGMEVGYDLIEVMACPGGCICGAGHPVPEKIDTLEKRQQVLVNIDQTSRYRKSQENPDILRLYDEYYGEANSPLAHKLLHTHYEAVKREPVAKHDRRMADSAFVTHELTLCTCDKCTAQGSRELFAALSGKIRKLKMDSFVTARTIRLKENHPGQGVYAAIDGKLIETPVEQLEQRIFQHLIR

SEQ ID NO: 56 - protein, 86 aa, Desulfitobacterium hafniense
MVSIVPCIAKKYEAARPEFRSEGIRDVDAVLTSTEMLEMADIKLIEPADVEPQDFCEPYKRVSGAGILFGASGGVAKRPCGWRWRN

SEQ ID NO: 57 - protein, 477 aa, Drosophila melanogaster
MSRLSRALQLTDIDDFITPSQICIKPVQIDKARSKTGAKIKIKGDGCFEESESGNLKLNKVDISLQDCLACSGCITSAEEVLITQQSREELLKVLQENSKNKASEDWDNVRTIVFTLATQPILSLAYRYQIGVEDAARHLNGYFRSLGADYVLSTKVADDIALLECRQEFVDRYRENENLTMLSSSCPGWVCYAEKTHGNFLLPYVSTTRSPQQIMGVLVKQILADKMNVPASRIYHVTVMPCYDKKLEASREDFFSKANNSRDVDCVITSVEVEQLLSEAQQPLSQYDLLDLDWPWSNVRPEFMVWAHEKTLSGGYAEHIFKYAAKHIFNEDLKTELEFKQLKNRDFREIILKQNGKTVLKFAIANGFRNIQNLVQKLKREKVSNYHFVEVMACPSGCINGGAQIRPTTGQHVRELTRKLEELYQNLPRSEPENSLTKHIYNDFLDGFQSDKSYDVLHTRYHDVVSELSISLNINW

SEQ ID NO: 58 - protein, 538 aa, S. pombe
MAKLSVNDLNDFLSPGAVCIKPAQVKKQESKNDIRIDGDAYYEVTKDTGETSELGIASISLNDCLACSGCITSAETVLVNLQSYQEVLKHLESRKSQEILYVSLSPQVRANLAAYYGLSLQEIQAVLEMVFIGKLGFHAILDTNASREIVLQQCAQEFCNSWLQSRAHKNQNQVTNSVVNEHPLIPHSTSQISGVHSNTSSNSGINENAVLPILSSSCPGWICYVEKTHSNLIPNLSRVRSPQQACGRILKDWAVQQFSMQRNDVWHLSLMPCFDKKLEASRDEFSENGVRDVDSVLTPKELVEMFKFLRIDPIELTKNPIPFQQSTDAIPFWYPRITYEEQIGSSSGGYMGYVLSYAAKMLFGIDDVGPYVSMNNKNGDLTEYTLRHPETNEQLISMATCYGFRNIQNLVRRVHGNSSVRKGRVLLKKRVRSNAQNPTEEPSRYDYVEVMACPGGCINGGGQLPFPSVERIVSARDWMQQVEKLYYEPGTRSVDQSAVSYMLEQWVKDPTLTPKFLHTSYRAVQTDNDNPLLLANKW

SEQ ID NO: 59 - protein, 119 aa, Metopus contortus
IIFAEKNYPEMVNHLSTTKSPMQMLSSLSKGYWAKEGKKIDPKNVVNVAIMPCTAKKAWKERPDMKADNGDPVTDYVLTTRELGTMLRQSNINPVSLPKTPFDKIMGESTGAAVIFGAT

SEQ ID NO: 60 - protein, 462 aa, Mus musculus
MKCEHCTRKECSKKSKNDDQENVSSDGAQPSDGASPAKESEEKGEFHKLADAKIFLSDCLACDSCVTVEEGVQLSQQSAKDFLHVLNLNKRCDTSKHRVLVVSVCPQSLPYFAAKFNLSVTDASRRLCGFLKSLGVHYVFDTTIAADFSILESQKEFVRRYHQHSEEQRELPMLTSACPGWVRYAERVLGRPIIPYLCTAKSPQQVMGSLVKDYFARQQNLSPEKIFHVVVAPCYDKKLEALREGLSTTLNGARGTDCVLTSGEIAQIMEQSDLSVKDIAVDTLFGDMKEVAVQRHDGVSSDGHLAHVFRHAAKELFGEHVEEITYRALRNKDFHEVTLEKNGEVLLRFAAAYGFRNIQNMIQKLKKGKLPYHFVEVLACPRGCLNGRGQAQTEDGHTDRALLQQMEGIYSGIPVRPPESSTHVQELYQEWLEGTESPKVQEVLHTSYQSLEPCTDGLDIKW

SEQ ID NO: 61 - protein, 457 aa, Caenorhabditis elegans
MEDSGFSGVVRLSNVSDFIAPNLDCIIPLETRTVEKKKEESQVNIRTKKPKDKESSKTEEKKSVKISLADCLACSGCITSAETVLVEEQSFGRVYEGIQNSKLSVVTVSPQAITSIAVKIGKSTNEVAKIIASFFRRLGVKYVIDSSFARKFAHSLIYEELSTTPSTSRPLLSSACPGFVCYAEKSHGELLIPKISKIRSPQAISGAIIKGFLAKREGLSPCDVFHAAVMPCFDKKLEASREQFKVDGTDVRETDCVISTAELLEEIIKLENDEAGDVENRSEEEQWLSALSKGSVIGDDGGASGGYADRIVRDFVLENGGGIVKTSKLNKNMFSTTVESEAGEILLRVAKVYGFRNVQNLVRKMKTKKEKTDYVEIMACPGGCANGGGQIRYETMDEREEKLIKVEALYEDLPRQDDEETWIKVREEWEKLDKNYRNLLFTDYRPVETNVAQVLKW

SEQ ID NO: 62 - protein, 462 aa, Mus musculus
MKCEHCTRKECSKKSKTDDQENVSSDGAQPSDGASPAKESEEKGEFHKLADAKIFLSDCLACDSCVTVEEGVQLSQQSAKDFLHVLNLNKRCDTSKHRVLVVSVCPQSLPYFAAKFNLSVTDASRRLCGFLKSLGVHYVFDTTIAADFSILESQKEFVRRYHQHSEEQRELPMLTSACPGWVRYAERVLGRPIIPYLCTAKSPQQVMGSLVKDYFARQQNLSPEKIFHVVVAPCYDKKLEALREGLSTTLNGARGTDCVLTSGEIAQIMEQSDLSVKDIAVDTLFGDMKEVAVQRHDGVSSDGHLAHVFRHAAKELFGEHVEEITYRALRNKDFHEVTLEKNGEVLLRFAAAYGFRNIQNMIQKLKKGKLPYHFVEVLACPRGCLNGRGQAQTEDGHTDRALLQQMEGIYSGIPVRPPESSTHVQELYQEWLEGTESPKVQEVLHTSYQSLEPCTDGLDIKW

SEQ ID NO: 63 - protein, 119 aa, Neocallimastix sp
IMFAEKNFPDMVNNLSTTKSPMQMLSSLTKGYWAKDIKKINPKDVVNVAIMPCTAKKQEKDRPGMKTDEGDKVTDFVLTTRELGMMLRQANIDPTKLPGTKFDKVMGESTGAAVIFGAT

SEQ ID NO: 64 - protein, 119 aa, Nyctotherus ovalis
IIFMEKNYPDMLSHLSTCKSPQGMLGALIKGYWAKKVKKVDPKDVVSVSIMPCTAKKAEKERPQLRGDEGFKDVDYVLTTRELAKMLKQSNIDLGKVEPTPFDAVMSEGTGAAVIFGVT

SEQ ID NO: 65 - protein, 490 aa, Clostridium perfringens
MAIKDANKQYIKFDTAVQVLKYEVLKRIAEKEFDGTLDKEKLNIAKEIVDDLKPNVRCCIYKERAIVEERMKLALGGHENRENMIEVIDIACDECPVNRFIVTDACRGCLAKKCRDSCNFGAISFDNRKCKIDYEKCKECGKCKEVCPYNAIAEVKRPCMRACIPKALSYDVDSKKAVIDDSKCIQCGACVVDCPFGAIMDKSYLVDVIRLLKDEKKVYAIVAPAISSQFNHSKIGKVITAIKKLGFEDVFEAALGADLVAVHECNEFKEKGELDFMTTSCCPAFVSYIEKNYPELKECISNTVSPMVAMARLIKSQNKDVKTVFIGPCIAKKTEAKRNEVSGDVDYVLTFEELLALLDSRNIKIDECEESDTKHGSFYGRLFARSGGVTESVKHLIDSEGIKVDFRPILGDGIKDCDIKLRLAKLKRAQGNFLEGMACKGGCINGPGSLNHDIKNSKEVDKYGELSSSEKIKDTLADIKFEDLNLSKNE

SEQ ID NO: 66 - protein, 456 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 67 - protein, 408 aa, Homo sapiens
MKCEHCTRKECSKKTKTDDQENVSADAPSPAQENGEKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 68 - protein, 502 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSEISQAWWCTPVITATREAAARESLEPGRQRLQRDKIAPLDSSLGGGGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 69 - protein, 448 aa, Clostridium tetani
MHNDYREIFKRLSKSYYDDTFEKEVENILSSHSMDREKLAKIISILCGVNIEHSENYISNLKNAIKNYTASAEKVVTKLPCSTQCAKDGDIICEKSCPVNAIFRDPNDNNIYINDELCLDCGLCVRNCPSGSILDKKEFIPLAELLKSESIVIAAVAPAIMGQFGENTTINQLRTAFKKLGFTDMVEVAFFADMLTLKEAVEYDHFVKDEQDFMITSCCCPMWVGMLKKVYNDLVKYVSPSVSPMIAAGRVLKLLNPNCKVVFVGPCIAKKAEAREKDLLGDIDFVLTFTELRDIFDVFDIQPENLEEDFSSEYASKGGRLYARTGGVSIAVSEAIEKLFPNKYKFLKTIQADGVKGCKSLLDKIKQEDISANFVEGMGCVGGCVGGPKVIIDPSEGRNAVNNFAENSSIKVSVDSNCMNDILSKININSVEDFKDKDKISIFEREFK

SEQ ID NO: 70 - protein, 459 aa, Desulfovibrio desulfuricans
MYFRTYDNTINFEIMVRIAKAFHGDSFEEQVARIPLEMRPRKAHSSRCCIYRDRAIIRYRCMAMLGYAIEDETDELTSLSQYAKGALERDSIQGSMLTFIDEACNGCVRTHYEATSACRGCLAEACVQHCPKDAVRIVDGKSRIDPDKCVQCGKCMNVCPYHAIVQIPIPCEESCPTGAISKDECGKQVIDYDRCIFCGKCMAACPFAAVLEKSQMIDVLRRIREGRKVVAIVAPAIAGQVQAPMSRLATALRQLGFADVAEVASGADTTARLEADEFVERMEHGAAFMTSSCCPAYTQLVDKHLPELAPFVSDTRTPMHYTAAMVKDHDPDMVTVFIGPCVAKRNEGKHDELVDHVLTFQEMVAMLTAAGISVDACEDGRFMFPAMREGRSFPVSGGVTAGVQAHIGTRAEVRPLSVDGLNKKTFRQLKTWAKKGCEGNFVEVMGCQGGCVAGPAIVM

SEQ ID NO: 71 - protein, 494 aa, Clostridium tetani
MIVFENQLKKLKYLVLKEVAKMTLEDRLGEEDIERISFDIIKGDKAEYRCCVYKERAIVYERAKLATGCLPNGQVAEEFVHVEDDDQIIYVIDAACDKCPINKYVVTEACRGCLQHKCMEVCPAGSINRAAGKAYINHETCKECGLCESACPYNAIAEVMRPCRRACPTGALQMNLEDNKATINKEDCINCGSCMSVCPFGAISDKSYIVDITKALKNNKKVYAMVAPAITGQFGKDVSVGKMKNAFKAMGFEDMLEVACGADAVAAHESEEFIERLESGKKYMTTSCCPGFLGYIEKKFPDQLENVSNTVSPMVAIGRMIKKEYEDSVVVFVGPCTAKKAEIKRKGIKDAVDYVMTFEEIAALMGAFEIDPAECEEEDINDGSNYGRGFAQGGGVVSAIQNCIKDKEGIKFNPLRVSGPDQIKRAMIMAKVGKLSENFIEGMMCEGGCIGGPATMVSAVKAKAPLMKFSKSSTIKDVKDNEVLDKYKDINMER

SEQ ID NO: 72 - protein, 203 aa, Arabidopsis thaliana
MDLIKLKGVDFKDLEESPLDRVLTNVTEEGDLYGVAGSSGGYAETIFRHAAKALFGQTIEGPLEFKTLRNSDFREVTLQLEGKTVLKFALCYGFQNLQNIVRRVKTRKCDYQYVEIMACPAGCLNGGGQIKPKTGQSQKELIHSLEATYMNDTTLNTDPYQNPTAKRLFEEWLKEPGSNEAKKYLHTQYHPVVKSVTSQLNNW

SEQ ID NO: 73 - protein, 449 aa, Clostridium perfringens
MNKKYNSLFKELISSYYSEDNFDEKLNDIVKNNFNSKEDAIEVLSSLCGVDIDKNSDNIAYDIRKAITTHKIKKNIVDKVSVCTKNCSKESKGKCQSLCPFDAILTDPIDNSKYIDPNLCQNCGICVQVCESGHFLDRIELLPIIDLIKNNETVIAAVAPAIAGQFGENVSLDMLREAFIKIGFSDMIEVAFAADMLSIKEAVEFNHHVEKTGDILITSCCCPMWVAMLRKCYKDLVKDVSPSVSPMIAAGRVIKKLNKDAKVVFIGPCIAKKAEAREKDLVGAIDYVLTFEELNGIFEALKIDPSSMKGVPSIEYTSRGGRLYARTGGVSEAINDVVKELYPDKAKIFKAVQANGVKECKELLNKVQSGELKANFIEGMGCVGGCVGGPKRIVDPSIGKKHVDEVAYNSPIKVATHSHTMDEVLLRLGINSLKSFEDKEKISIFEREF

SEQ ID NO: 74 - protein, 359 aa, Desulfitobacterium hafniense
MAQSEIMKIRRQVLKSALDWVSHDQNRKDRATLARQIIPDGTPRYRCCIHKERAVIEERLKAVLEPDEGPIVRVLKEGCNGCEMHRYSVTDHCQNCVGHFCFTNCPKKAILFINNKAFIDQTRCVECGLCARNCPYHAIIEYRRPCEDSCPTKAISVREDRIASIAEAHCTSCGKCIISCPFGAVAESSQLIHLFEAVRNPEHKIYAVIAPAFVGQFGRKVSPGQVKSALLKLGFQDVLEAALGADRTIELEAREYDERLAHGEEFMTSSCCPAYVSAVIKEKPDLFHHISSTLSPMAQVAHILKEKDPEAKIAFIGPCVAKKEEGKRPETKVDFVLTFEELMVWLDYAGINPAEESEQ

SEQ ID NO: 75 - protein, 790 aa, Geobacter metallireducens
MCHWLHREAGLVYDPAVDQAINRVSGLTLSAGRTMEPIITVKEKCRKCYCCVRSCPVKAIKVAKSYTEIIVDRCIGCGNCLSNCPQQAKMVADKVGVTEKLLSSGEEVIAVLGSSFPAFFHNVTPGQLVAGLRKIGFAEVHEGSYGAELIADDYARITSEKGHPRISSHCPAIVDLIERHYPKLVGNLVPVVSPMVAMGRYLKGTLGQHVRVVYISSCVANKLETQTQETRGAVDIVLTYRELEGIFRSRQIALPALADEPLDGIRPGAGRLFPIADGTFRAFGIPFDPLDTEIVAACGEVNVMGIINDLAAGRISPRIADLRFCYDGCIGGPGRNRALTEFYRRNRVIAHFKQEVPCRTVPNSLLEAGRVSFGRSFASKYAKLEAPKANDVRKILNATNKFTVKDELNCRACGYRTCREYAVAVFQGLAEIEMCLPYNLQQLEEDRGRLIQKYELARRELEREYGDEFIVGNDRKTLDVLGLIKQVGPTPTTVLIRGESGTGKELTARAIHRYSKRNDKPLVTVNCTTITDSLLESELFGHKRGAFTGAVADKKGLFEAADGGTIFLDEIGDITPKLQAELLRVLDMGEVRPVGGTAAKKVDVRLIAATNKNLEQGVREGWFREDLYYRLNVFTITMPPLRSRVESIPILVHHFMDKASTKLNKRMVGIEDRAVKALTKYPWPGNIREMQNVIERAAVLTHDGVIRVENFPLALSEGLEEGFATGLDIHAASFRSEREQHMGKLEKKLIQRYLTEANGNISRAAKLANIPRRTFYRLLDKYRLRERDVR

SEQ ID NO: 76 - protein, 450 aa, Clostridium acetobutylicum
MNNKYIELFKSLVDSYYNDTFDSFVYHILSDEEVDKKELSKVISSLCGVSVEFKDTETYISELKKAISNYKCTDNIVEKIKECDSSCHSNEGETPCQKSCPFDAILVDKNTKTSHIQKDLCTDCGNCITSCPSGSILDKIEFMPLLNLFKNNETVIAAVAPAIAGQFGENVSLEMLRTAFKKVGFADMVEVAFFADMLTIKEAFEFNELVNSKDDLMITSCCCPMWVSMIRKIYKDLARHVSPSVSPMIASGRVIKKLNPNCKVVFIGPCIAKKAESRSQDISDAIDFVLTFEELKGIFDVLDIDPEKLPETHTKSYASREGRLYGRTGGVSTSVDEAVKRIFPNKHHLFKSTKVDGVKDCKDILNKTQAGNIGANFLEGMGCVGGCVGGPKAIVHKDQGRESVNKTAESSEIKISVDSERMKDILSRIGINSIEDFGDKSKVDIFERRF

SEQ ID NO: 77 - protein, 106 aa, Shewanella oneidensis
MNKKKHLFAEDSFFLSRRKFMAVGAAFVAALAIPIGWFTSKLERRNEYIKARSQGLYKDDSLAKTRVSHANPAVEKYYKEFGGEPLGHMSHELLHTHFVDRTKLSS

SEQ ID NO: 78 - protein, 504 aa, Entamoeba histolytica
MSTQLTPLRNKIISEVVKCFKSGRFIEDIDKLPTILTDGDGWKPTSKFVHSREQEEGIYREKVLSVLGFVDGEYDDITPLHVYAQKALERTSLHEPVFGISQKGCNKCHFNGYFVTQACEGCTSRPCSVNCPKKCISFGEDGRAVINQNNCIKCGRCYKFCPYGAIISKSVPCVKACPCGAMLDSPEGVKTIDFEKCINCGGCMRACPFGAILPRSNLIDVLKILPTKKVVACPAPSIAAHFGKYDLALVSGGLIQVGFTSVEDVSYGADLCALNEAKEFEERIVKNKKDFMTTSCCPAYINAINKHMPELKENVSHTPTPMHFATQAVKDRDQETVTVFIGPCNAKRWETLQDSTTDYCLTFDEIFGLFEGSGIDLSKVQPYTFVDKAHKEGKIFAVSGGVASAVASLLPKEVPDGVIKPTIIDGFSQENFKRLKNFKKNITGNLVEVMVCEGGCAYGPGCPGLNTPATSAKIKIAVDKMEAHPEGRWVGLPNSQIKPIKVEN

SEQ ID NO: 79 - protein, 560 aa, Cryptosporidium parvum
MFSTAVKLANLDDYLESSQDCIVSLLSDKDDTKPKIAVMRPAKAQGNKDDKKSGTSDKATVNVADCLACSGCVTSAEAKLLEDQNVSEFMNILKQKRLTVVSISNQSCSSFACHLNCDLITIQRKLSGLFKHIGARFVMNSTISEYISLLETKYEFISRYKAKSDLPMIISHCPGWICYSEKSLNSSVLPLLSKVRSAQQLQGILIKTLTLEIYNQLLFLYKFRLSNSYRTNMNVKSTFTQNDNFVEQSDIFHVAIMPCHDKKLESTRSSLSLKSSDKNSSCPEVDIVLATSEVGEIIKLAGFNSLLDVPEAPLDNLWLNQNFQITKKHNLSLLITENYVSNQILNQFSWLIPSYFNSNSGGFCEYIIRSAIKELAGDHIDNKVQLPFNKLKNDILEAKYIKNNVELNYCLAYGFRAIQSISRKLNLQKNASQNTQYKQSVVNHVNYHLIEAMACPTGCVSGGGQILSQNDQNDDNSDLNKLRKNIKFIDEVQEALYKGINLNKNQEVILPDEIPIVNILYEYLIHIDKQIDRSSGLKLPFLRNDFVSINEVPTASSLKW

SEQ ID NO: 80 - protein, 469 aa, Kluyveromyces lactis
MSALLRDADLNDFISPGLACVKPAQPQKVEKKPSFEVEVGIESSEPEKVSISLQDCLACAGCITSSEEILLSKQSHKVFLEKWSELEELDERSLAVSISPQCRLSLADYYSMCLADLDRCFQNFMKTKFNAKYVVGTQFGRSISISRINATLKDRVPENEGPLLCSVCPGFVLYAEKTKPELIPHMLDVKSPQQITGNLLKQADPTCYHLSIMPCFDKKLEASREECEKEVDCVITPKQFVAMLGDLSIDFKSYMTEYDSSKELCPSGWDYKLHWLSNEGSSSGGYAYQYLLSLQSSNPESDIITIEGKNSDVTEYRLVSKSKGVIASSSEVYGFRNIQNLVRKLSQSASVKKRGIKVKRRGQSVLKSGETSEKTTKVLTADPAKTDFVEVMACPSGCINGGGLLNEEKNANRRKQLAQDLSLAYTKVHSVNIPDIVHAYDDKSNDFKYNLRVIEPSTSSDVVAVGNTW

SEQ ID NO: 81 - protein, 365 aa, Encephalitozoon cuniculi
MDALIRPPMSFFADLPKDNKKCIKIGSPLALSLSDCLACSGCVSADEAGALSEDLSFVLDLSPQTSFVLSPQSKINIFNLYREDGMEYREFEAVLSSFLRSKFNIHRIVDTSYLRSKIYEETYREYMATNHLIVSACPGVVTYIERTAPYLIGYLSRVKSPQQMAFSLVKGSRTVSVMPCQDKKLENGRDGVKFDFILTTRGFCKALDSLGFRRPARASGKSLCSMEEAETTQWNIGTSSGGYAEFILGKHCVVETREIRNGIKEHLLDDGRTISQITGLENSINYFKSSKTKGPRHKMTEIFLCKNGCIGGPGQERVNDVEMDIREYDRNGREQPRIFYSSPGLEEKRVFREVKAKRVDLRVDW

SEQ ID NO: 82 - protein, 127 aa, Tritrichomonas foetus
  misc_feature (85)..(85): Xaa can be any naturally occurring amino acid
  misc_feature (124)..(124): Xaa can be any naturally occurring amino acid
MCIKACNSVAGQGVLKLVKVGNKKLVSTKSGKPLQETNCIKCGQCTLVCGPGALTQKDAIQTVSEVLKNPGDKVLVCQTAPAIRXNLADGLGMPAGSIITGKMVTALKMLGFKYVFDTNFGTDXTIG

SEQ ID NO: 83 - protein, 449 aa, Scenedesmus obliquus
MPEWQPGGRYAVSVRPPVNRRAVVAAERRRLVVRAAGPTAECDCPPAPAPKAPHWQQTLDELAKPKEQRKVMIAQIAPAVRVAIAETMGLNPGDVTVGQMVTGLRMLGFDYVFDTLFGADLTIMEEGTELRHRLQDHLEQHPNKEEPLPMFTSCCPGWVAMVEKSNPELIPYLSSCKSPQMMLGAVIKNYFAAEAGAKPEDICNVSVMPCVRKQGEADREWFNTTGAGGANVDHVMTTAELGKIFVERGIKLNDLQESPFDNPVGEGSGGGVLFGTTGGVMEAALRTVYEVVTQKPLDRIVFEDVRGLEGIKESTLHLTPGPTSPFKAFAGADGTGITLNIAVANGLGNAKKLIKQLAAGESKYDFIEVMACPGGCIGGGGQPRSADKQILQKRQAAMYDLDERAVIRRSHENPLIGALYEKFLGEPNGHKAHELLHTHYVAGGVPDEK

SEQ ID NO: 84 - protein, 477 aa, Anopheles gambiae
SRFSSALQLTDLDDFITPSQECIKPVKIETSKSKTGAKITIQEDGSYVQESSSGIQKLEKVEITLADCLACSGCITSAEGVLISQQSQEELLRVMNANNLAKLNNQRDEIKFVVFTVSQQPILSLARKYNLTPEDTFEHIAGYFKKLGADMVVDTKIADDLALIECRNEFIERYNTNRKLLPMLASSCPGWVCYAEKTHGNFILPYIATTRSPQQIMGVLVKQYLAKQLQTTGDRIYHVTVMPCYDKKLEASREDFFSEVENSRDVDCVITSIEIEQMLNSLDLPSLQLVERCAIDWPWPTVRPSAFVWGHESSGSGGYAEYIFKYAARKLFNVQLDTVAFKPLRNNDMREAVLEQNGQVLMRFAIANGFRNIQNMVQKLKRGKSTYDYVEIMACPSGCLNGGAQIRPEEGRAARELTAELECMYRSLPQSTPENDCVQTMYATFFDSEGDLNKRQSLLHTSYHQIEKINSALNIKW

SEQ ID NO: 85 - protein, 410 aa, Shewanella oneidensis
MTTTTYQPGEIQGLIKINASKCKGCDACKQFCPTHAINGASGAVHSIDEDKCLSCGQCLINCPFSAIEETHSALETVIKKLADKNTTVVGIIAPAVRVAIGEEFGLGTGELVTGKLYGAMNQAGFKIFDCNFAADLTIMEEGSEFIHRLHANVKGEANAGPLPQFTSCCPGWVRYLETRYPALLPNLSTAKSPQQMAGTVAKTYGAKVYQMQPENIFTVSVMPCTSKKLEASRPEFNSAWQYHQEHGANSPSYQDIDAVLTTREMAQLLKLLDIDLANTAEYQGDSLFSEYTGAGTIFGTTGGVMEAALRTAHKVLTGTEMAKLEFEPVRGLKGVKSASVSLFDTELNQDVTVNVAVVHDMGNNIEPVLRDVMAGTSPYHFIEVMNCAGGCVNGGGQPIEGKGSSWLGNI

SEQ ID NO: 86 - protein, 606 aa, Clostridium thermocellum
MAFVWRNVRSRPFPKKPNGRGCEKMQMVNVTIDNCKIQVPANYTVLEAAKQANIDIPTLCFLKDINEVGACRMCVVEVKGARSLQAACVYPVSEGLEVYTQTPAVREARKVTLELILSNHEKKCLTCVRSENCELQRLAKDLNVKDIRFEGEMSNLPIDDLSPSVVRDPNKCVLCRRCVSMCKNVQTVGAIDVTERGFRTTVSTAFNKPLSEVPCVNCGQCINVCPVGALREKDDIDKVWEALANPELHVVVQTAPAVRVALGEEFGMPIGSRVTGKMVAALSRLGFKKVFDTDTAADLTIMEEGTELINRIKNGGKLPLITSCSPGWIKFCEHNYPEFLDNLSSCKSPHEMFGAVLKSYYAQKNGIDPSKVFVVSIMPCTAKKFEAQRPELSSTGYPDVDVVLTTRELARMIKETGIDFNSLPDKQFDDPMGEASGAGVIFGATGGVMEAAIRTVGELLSGKPADKIEYTEVRGLDGIKEASIELDGFTLKAAVAHGLGNARKLLDKIKAGEADYHFIEIMACPGGCINGGGQPIQPSSVRNWKDIRCERAKAIYEEDESLPIRKSHENPKIKMLYEEFFGEPGSHKAHELLHTHYEKRENYPVK

SEQ ID NO: 87 - protein, 279 aa, Desulfitobacterium hafniense
MTMGQLRAALKHLGFYGMIEVALFADVLSLKEALEFDKHVQTDKDFVLTSCCCPIWVGMVKRVYDTLVPHISPSVSPMVACGRGIKRLHPDAKTVFIGPCIAKKAEAKEPDIRDAVDAVLTFHELKQIFEATDIEPSEMEDIPSEHSSTSGRIYARTGGVSKSISDTLNRIRPDKPVKIKSIQANGIKECKALLNDIMNNEIKANFYEGMGCPGGCVGGPKAIVDVDRGTEFVNKYGAEADALTPADNQHVLELLKQLGIDSVEELLGGESAAIFQRDF

SEQ ID NO: 88 - DNA, 1563 bp, Rhodospirillum rubrum
atgcgacctgtgcagcggcctcgccgatggcccggcctgcgtcaacgcctgtccccagaacgtcctgtcgatcgtcgatcccgccgccgaagtggcgcggcgcgccctgggcgccgtcgaggatctggtgtccagcatgaaattctccggtctgtgagccagagggatatgagcatgtcgatccaaccgaccgtaaccatcgatcccgagctgtgtaccggatgtgggcggtgtgttgaaacctgtccggttcaggcgatcgccggcagccggggcaaggcccatgagatcgaggcggcggcttgcgtgtcctgcgggcggtgcgtcgccacctgcgccgcctttgattcgattttcgacgccttcccgacgccgcgcccggtccgcctgaaacggcgcggccttcccggttcgctgaaggagccgttgttcgccgcccatgatcccagccggatcgaggcggtgcgcaaggccttcgccacccccaagcggatgacggtgatgcaggtcgacaccatggcctgcgtcgccctggccgaggatttcggcctgcccccgggcagcctgtcgccgctcaagatcgccagcgccgcccgccagctgggcttcgatcgggtgtaccgcaccagtttccccgccggtctggcggtgttggaaaccgcccacgagatggcggcccgtctggccaatggcggcaatctgccggtgatcaattcgtcgtgtccggcggtggtggccttcctggaacggcgctatcccgagcttttgcattacctgtcgacggtgaagtccccccatcagatcgccggcgccctctacaactcctatctcgccgatgccgccaatctcgccccggcgaatattcacaaggtctcggtcgtcgcctgcctgtcccataaggccgaggccgaacgtcccgagatgatgacctgcggctgcccggatatcgatacggtgctgaccgcccgcgagctcgccatcctgatcaaggacgccggcatcgacgtgcctttgctgggcgatggcgaattcgacaacgattttcccgagatcgaaggcctcgacaccctttattgcgctcccggcgatgtgtcgcgggcggtgctgggcgccgggcgctggttcctgggccagggcgaaggcgtcggcgcgccggcgggcgaaaccgtcgaggtgcttgacgaggccacccggctgacccggctggcctatcccggcggcacgcttcaggcgctgacggtggccggcttcgacaaggccgttccctatcttgaagcgatcaaggccgggcgcaatgccttccagttcctggagatcgcgtcttgtccccagggctgcgcctcgggggcggggttgcccaaggtgctgctggaaaccgagaaaccggcgcgctaccgcgcccggatcgagaacctgccgccggcggcgcccgaggcgtggagccggcttcccggccatccgtcgatcgtcgccctctatggcggctacttcggcaaggccatcggcgacaagtcgaaccgccgtctccacacccaatacgccgaacctgcggccgccccctaa

SEQ ID NO: 89 - DNA, 1725 bp, Clostriduim pasteuranum
atgaaaacaataattataaatggtgtacagtttaatactgatgaagacactactatattaaaatttgcacgagacaacaatattgatatatctgcactgtgttttttaaataattgtaataatgacataaataagtgtgaaatatgtactgtagaggtagagggtactggattagtaacagcctgtgatacattaattgaggatggtatgattataaacacaaattccgatgctgtcaacgaaaaaattaaatctagaatatctcaattattagacatacatgaattcaaatgtggtccttgcaatagaagagaaaactgtgaattcttaaaacttgttataaaatataaagcaagagcttctaaaccatttttacctaaagataagactgaatatgtagatgaaagaagtaaatcattaactgtagataggacaaaatgcttattatgtggaagatgtgttaatgcctgtggaaaaaatactgaaacctatgcaatgaaatttttaaacaaaaatggtaaaactataattggagcagaggatgaaaaatgctttgatgatactaattgtctattatgtggtcaatgtataatcgcctgtccagtagcagcattatcggaaaaatcacacatggatagagtaaaaaatgccttaaatgcccctgaaaaacatgtaatagtagctatggctccatctgtcagagcttctataggtgaactttttaatatgggatttggcgttgacgtaacaggaaaaatttatactgctttaagacagcttggatttgataaaatattcgatataaacttcggagcagatatgacaattatggaagaggctacagaattagttcaaagaatagagaataatggacctttcccaatgtttacatcttgctgcccaggttgggtaagacaagctgaaaattattatcctgaattactaaataatctttcatcagctaaatcacctcaacaaatttttggtactgctagtaaaacttattatccttctatatctggtcttgacccaaagaatgtatttactgtaacagttatgccctgtacttcaaaaaaatttgaagcagatagaccacaaatggaaaaagacggcctaagagatatagatgctgttataactactcgagaattagcaaaaatgattaaagatgctaaaataccatttgctaaacttgaagatagcgaagcagaccctgctatgggagaatacagcggtgctggtgccatatttggtgcaactggcggagttatggaagcagctttaagaagtgcaaaagactttgctgaaaacgctgaacttgaagatatagaatataagcaagttagaggattaaatggtataaaagaagctgaagtagaaataaataacaacaaatataatgtagctgttataaatggtgcttcaaatttatttaagtttatgaaatctggtatgattaacgaaaaacaatatcatttcatagaagtaatggcttgtcatggaggatgtgtaaatggtggtggacagcctcatgtaaacccaaaagatttagaaaaagtagacataaaaaaagtaagagcttctgtattgtataatcaggatgaacatctttccaagagaaaatctcatgaaaatactgcattagttaaaatgtatcaaaattattttggcaaaccaggtgaaggtcgtgcccatgaaatattacactttaaatataaaaaataa

SEQ ID NO: 90 - DNA, 1266 bp, Desulfovibrio vulgaris
atgagccgtaccgtcatggagcgcatcgaatatgagatgcacactccggaccccaaggccgatccggacaagctccacttcgtccagatcgacgaggcaaagtgcataggctgcgacacctgttcgcagtactgccccaccgccgccatcttcggcgaaatgggcgaaccgcactccattccccacatcgaggcgtgcatcaactgcggccagtgcctcacgcactgccccgagaacgccatctacgaggcacagtcgtgggtgcctgaagtcgagaagaagctgaaggacggcaaggtgaaatgcatcgccatgcccgcccccgccgtgcgctatgcactgggcgacgccttcggcatgcccgtcggttccgtcaccaccggcaagatgctcgcggccctgcagaagctcggcttcgctcattgctgggacaccgagttcaccgctgacgtgaccatctgggaagaggggtccgagttcgtggaacgcctcaccaagaagagcgacatgccgctgccgcagttcacctcgtgctgccccggctggcagaagtatgccgagacctactaccccgaactgctgccgcacttctccacgtgcaagtcgcccatcggcatgaacggcgcactggcgaagacctacggcgcagagcggatgaagtacgaccccaagcaggtctacaccgtctccatcatgccctgcatcgcaaagaagtacgaagggttgcgtcccgaactgaagtccagcggcatgcgcgacatcgacgccacgctgaccacccgtgagctggcctacatgatcaagaaggccggtatcgacttcgcgaaactccccgacggcaagcgtgacagcctcatgggtgaatccaccggcggtgccaccatcttcggcgtcaccggcggcgtcatggaagcggcactccgcttcgcctacgaagccgtcaccggcaagaagcccgacagctgggacttcaaggccgtgcgcggtcttgatggcatcaaggaagccaccgtcaacgtcggcggtaccgacgtcaaggtcgccgtggtgcacggggccaagcggttcaagcaggtctgcgacgatgtgaaggcgggcaagtcgccctatcacttcatcgaatacatggcctgccccggcggctgcgtctgtggcggcggtcagcccgtcatgcccggcgtgctcgaagccatggaccgcaccaccacccgcctttacgcgggcctgaagaagcgcctcgccatggcgagcgccaacaaggcatag

SEQ ID NO: 91 - DNA, 1407 bp, Entamoeba histolytica
atgccacctaaaccatcacatacactcaccggacatgaccataaccatagtattcaatttgattggtctaaatgcatgggttgtggaatgtgtgctactaaatgtacttttggggtgttagtaaaacaaccaccaaaaattccaccatttgttcagcctaatagagaaaaactctctcaagaaaataccgacaagacaagagtacttattgatgagtctgaatgtactgggtgtggtcaatgttctttggtttgtaactttggttctattacaccaatagaccatcttgttgatacttttaaagctaaagaagctggaaagaagcttgttgctatgattgcaccttcaactcgtttaggtgttgctgaggctatgggaatgcctattggaagtacagctatggctcagttagttcattgtttaagacttattggatttgattatgtatttgatgttgatgctggagctgataagacaacaatggatgattatgccgaagttattgaaatgaaaaaagaaggaaaaggacctgctattacttcctgttgtcctgcttggattgaacttgttgaaaaagaatatcctgacttaattccaaacgtctctactgcccgttcaccaattggatgtttagctggttgtattaaaagaggatgggcaaaggatgtaggaattgcagtagaagatctttacactgttggaataatgccttgtattgctaaaaaaacagagtctcaaagacaacaaattcatcaagactatgatgcttcatgtacttcaaatgaaattgctgcttatttcaaaaaacatcttccacctgaagaatgtaaatttacacaagaaagagaagaagcacttgctaaaactgaagatggtcaatgtgatttaccatttagacgtatttctggtggttctaatatttttggaaagactggaggagtttgtgaaactgtattgagagtaattgcacgtaatgcaggagttgattggaacagttgtactgttaacaaggaagaaacttttaaacatgctgcaagtggatcaacaatgacaaatctttctgttgatattggtggaactattatcacaggtgctgtttgtcatggtggttatgctattagacatgcttgtgaacttattagaaaaggagagttaaaagttgatgttgttgaaatgatggcatgtgttggaggttgtcttggaggagcaggtcaaccaaaaattccaccagcaaagaaacttgagatggataagagaagagtaatgttagatattttagatcaacaaactgatattagagctgctaatgaaaatactgatgttcttggatggattgataaacattttgatcatcaaggtgcacatcagcatcttcacacatattttactcccagatatcaaaactaa

SEQ ID NO: 92 - DNA, 1350 bp, Scenedesmus obliquus
atgcctgagtggcaaccgggaggtcggtatgctgtttctgtccgcccgccagtgaacaggcgggctgtggtggcagcagagcgcaggcgccttgttgtgcgggcagctggcccaacagcagaatgtgattgcccaccagctcccgcgcccaaggccccgcactggcagcagacgctagatgagctagccaagcctaaggagcagcgcaaggtgatgatcgcccagatcgcaccagcagtgcgcgtggctattgcagagaccatgggactcaaccctggggatgtgacagttggccagatggtgaccggcctgcgcatgctgggctttgattatgtgtttgacacgctgtttggtgctgacctcaccatcatggaggagggcacagagctacggcacaggcttcaggaccacctggagcagcaccccaacaaggaggagccgctgcccatgttcaccagctgctgccctggctgggtggccatggtggagaagtccaaccccgagctcatcccctacctgtcttcctgcaagtcgccccagatgatgctgggcgcagtcatcaagaactacttcgctgccgaggccggcgccaagcctgaggacatctgcaacgtgagcgtgatgccctgcgtgcgcaagcagggcgaggctgaccgcgagtggttcaacaccacaggggctggcggcgcgaacgtggaccacgtcatgacaactgcagagctgggcaagatctttgtggagcgcggaatcaagctgaacgacctgcaggagtcgccctttgacaaccccgtcggcgagggcagcggcggcggcgtgctgttcggcaccactggaggcgtgatggaggcggcgctgcgcaccgtgtacgaagtggtcacacagaagcctttggaccgcatcgtctttgaggacgtgcgcggcctggagggcatcaaggagtccacgctgcacctcaccccaggccccaccagccccttcaaggcctttgcaggcgcagacggcaccggcatcaccctcaacatcgcggtcgccaacggcctcggcaatgccaagaagctcatcaagcagctggctgcaggcgagagcaagtacgacttcatcgaggtcatggcctgccccggcggctgcatcggcggcggcggccagccgcgcagcgcggacaagcagatcctgcagaagcgccaggcggccatgtacgacctggacgagcgcgcggtgatccggcgcagccacgagaacccgctgattggcgcgctgtatgagaagttcctgggcgagcccaacggccacaaggcgcacgagctgctgcacacgcactacgtggccggcggcgtgcccgatgagaagtga

SEQ ID NO: 93 - DNA, 1311 bp, Chlorella fusca
atgtgttgccccgtggttgcaagtaggcacgcagggcgtgcaaggcatgttgctgtccgtgcagcagggccaacatctgagtgtgattgtcctccaacacctcaggccaagctgcctcactggcagcaggctctggatgagctcgccaagcccaaggagagcaggaggttgatgatcgcgcaaatcgcctccgctgttcgtgtcgctattgctgagaccattggcttggccccaggagatgtcaccattgggcagctcgtgactgggctgcgtatgcttggctttgattatgtctttgacaccctgtttggtgctgacctgaccattatggaggagggaacggagctgctgcatcgcctgcaggaccatctggagcagcaccccaacaaggaggagccactgcccatgttcaccagttgctgcccaggctgggttgccatggttgaaaagagcaatcctgagctcatcccctacctgtcatcttgcaagtcgcctcagatgatgcttggggccgttatcaagaactactatgcacagcaggttggagtgcagcccagtgacatctgcaacgtgtcagtcatgccatgcgtacgcaagcagggagaggctgaccgggagtggttcaacaccacaggtgcaggccttgcccgtgatgttgatcatgtggtgactactgctgaggttggtaagatattcctggagcgtggcatcaagctgaatgagctgccagagagcaactttgacaaccccattggcgagggcacaggtggtgctctgctgtttggcaccactggaggtgtcatggaggcagcacttcgcacagtctatgaagtggtgacccagaagcccatgggtcgtgttgactttgaggaggtgcgaggccttgaaggaatcaaggaggcagagatcacactcaagccaggagacgacagcccattcaaagccttcgcaggagctgatgggcagggcatcacgctcaagattgcagtagccaatgggcttggcaatgccaagaagctcatcaagagcctgtcagagggcaaggccaagtatgatttcattgaggtcatggcatgccctggtggctgcattggcggaggcggtcagccccgcagtactgacaagcagatcctgcagaagcgccagcaggctatgtacaacctggatgagcgcagtaccatccgccgcagccatgataacccattcatccaggcgctgtatgacaagttcctaggcgcacccaacagccacaaggcacatgatctgctgcacacacactatgtggcaggtggaattccagaggagaagtga

SEQ ID NO: 94 - DNA, 1725 bp, Clostridium saccharobutylicum
atgataaacatagtaattgatgaaaaaactattcaagtacaggaaaatactacagttatacaagctgccctagcaaatgggatagatataccaagtttatgctatcttaatgagtgtggtaatgttggaaagtgtggagtgtgtgcagtagaaatagaaggaaaaaataacttagcacttgcatgtataacaaaagttgaagaaggtatggtagtaaaaacaaactcagaaaaagtacaagaaagagttaaaatgagagttgctactttgcttgataagcatgaatttaaatgtggaccttgtccaagaagagaaaattgcgaatttttaaagttagttataaaaacaaaagctaaggctaacaagccttttgtggttgaagacaaatcacaatacatagatattagaagtaaatcaattgtaatagacagaactaagtgtgtgctatgcggaagatgtgaagcagcatgtaaaacaaagacaggtacaggagctatttcaatttgtaagagtgaatcaggaagaatagtgcaagcaacaggcggaaagtgctttgatgatacaaattgtttattatgtggacaatgcgttgcagcatgtccagtaggagctttaactgaaaaaacacacgttgatagagttaaagaagcattagaagatcctaataagcatgtaatagttgctatggcaccatcaatcagaacttctatgggagagttatttaaattaggctatggggttgatgtaactggaaaattatatgcttcaatgagagcattaggatttgataaggtatttgatattaactttggggctgatatgacaataatggaagaagcaacagagtttattgaaagagttaaaaataatggaccattcccaatgtttacttcatgttgtccggcatgggttagacaagtggaaaattattacccagaatttttagaaaacttatcatcagctaaatcaccacaacaaatatttggtgcagcaagcaaaacatactatcctcaaatatcaggtataagtgctaaagatgtatttactgttacaataatgccttgtacagcaaagaaatttgaggctgatagagaagaaatgtataatgagggaattaaaaatatagatgcagtacttactacaagagaattagcaaaaatgattaaagatgcaaagattaattttgctaatttagaagacgaacaagctgatccagcaatgggagaatacactggggctggagttatattcggagctacaggtggagttatggaagcagcacttagaactgctaaggatttcgttgaagataaagatttaactgatatagaatatacacaaataagaggattacaaggaataaaagaggctacagtagaaattggtggagaaaattataacgtagctgtaattaatggtgcagcaaacttagctgaattcatgaatagcggtaaaatccttgaaaagaactatcattttattgaagtaatggcttgcccaggcggatgtgtaaatggtggaggacaaccacacgtaagtgcaaaggaaagagaaaaagtagatgttagaactgtaagagcatctgttttatataaccaagataaaaatttagagaagagaaaatcacataaaaatacagcattattaaatatgtactatgattatatgggagctccaggacaaggaaaagctcatgaattattacacttaaaatacaataaataa

SEQ ID NO: 95 - DNA, 1266 bp, Desulfovibrio vulgaris
atgagccgtatcgaaatggagaagatcttctacgaagaccacgctccggaccccaaggccgatcccgacaagctcttcttcatccagatcgatgaatcgaagtgcatcggatgcgacagctgccagcagtactgccccaccggcgccattttcggcgacacgggcgacgcgcacaagattccccacgaggaactgtgcatcaactgcggccagtgtctgacccactgccccgtgggcgccatctacgaatcgcagtcgtgggtgaccgagatcgagaagaagatcaaggccaaggacgtcaaggtcatcgccatgcccgcgcccgccgtgcgctacgccctgggcgacgctttcggcctgcccgtgggcaccgtgaccaccggcaagatgttctcggcgctcaaggaactgggcttcgaccactgctgggacaacgaattcaccgccgacgtgaccatctgggaagaaggcaccgaattcgtgcagcgcctgaccaagaagctggacaagccgctgccccagttcacctcgtgctgcccaggctggcacaagtacgtggaatcgctgtatccggaactattcccgcacatgtcgtcgtgcaagtcgcccatcggcatgctgggcacgctggccaagacctacggcgcggaccgcatgaagtacgaccgggccaaggtgtacacggtgtccatcatgccgtgcacagccaagaagtacgaaggcatgcgcccgcagttgtgggacagcggccacaaggacatcgacgccaccatcgacacccgcgaactggcgtacatgatcaagaaggccaagatcgacttcaccaagctgcccgacggcaagcgcgataccctgatgggcgaatccaccggcggcgcgaccctgttcggcgtcaccggcggcgtcatggaagcggcgctgcgctacgcctaccaggccgtcaccggcaagaagccggaaagcatggacttcaagggcgtgcgtggcttgcagggcgtgaaggaagccacggtgaacgtgggcggcgtggacgtgaaggtggccgtggtgcacggggccaggcgcttccatgacgtgtgcgaactggtgaaggcgggcaaggccccgtggcacttcatcgagttcatggcctgccccggcggttgcgtgtgcggcggcggccagccggtgatgcccggcgtgctcgaagccgccgaccgcaggtcgacccggatgtacgcgggcctcaagaagcgcctggccatggccagcgccagccgggcatag

SEQ ID NO: 96 - DNA, 375 bp, Desulfovibrio vulgaris
atgcagatagtcaaccttacccggcgcggcttcctgaaggccgcctgcgtcgtcaccggcggcgccctgatcagcatccgcatgaccggcaaggccgtggccgccgccaagcagctgaaggattacatgatggaccgcatcaacggggtgtacggggcggacgccaagttcccggtgcgcgcctcgcaggataacgtgcaggtccagaagctgtacgcggacttcctggaaaagcccatgagccacaaggccgaacagttgctgcacacccactgggtggaccgctccaaggccatagaacgcatgaaggcgcaaggggcctaccccaacccgcgcgccaaggaattcgagggcaacacctacccctacgaatag

SEQ ID NO: 97 - DNA, 1821 bp, Desulfovibrio vulgaris
atgaacgcgttcatcaatggcaaggaagtccggtgtgaaccgggcaggacgatacttgaggccgcacgcgagaacgggcacttcattcccacgttgtgcgaacttgccgacatcggtcatgcacccgggacgtgccgggtctgtctggtcgagatatggcgtgacaaggaggccgggccgcagattgtcacctcctgtacgacccccgtcgaggagggaatgcgcatcttcacgcgtacccctgaagtacgcaggatgcagcggctacaggtcgaactgctgctggccgaccatgaccatgactgcgcagcctgcgcccgtcatggagactgcgagttgcaggatgtggcacaattcgtgggtcttaccggtacgcgtcaccattttccggactatgcccgcagccgcacccgtgatgtctcttcgccgtccgtcgtgcgcgacatgggcaagtgcatcaggtgcctgcgctgtgtcgccgtgtgccgcaacgtacagggcgtcgatgccctcgtggtgacgggaaacggcatcggcaccgaaatcgggctgcggcacaatcgtagccagagtgcgtccgactgtgtgggctgtggccagtgcacattggtctgccctgtgggggcattggctggacgggacgacgtggagcgtgtcatcgactatctctacgaccccgaaatcgtcaccgtgttccagttcgccccggcggtgcgggtgggcctcggtgaggagttcgggctgcctcccggttcaagcgtggaagggcaggtgcccacggccttgcgccttctcggggcagacgtggtactcgataccaacttcgcagccgacctcgtcatcatggaggagggcaccgaactcctgcaacgtcttcggggcggggcgaagctgccgctcttcacctcctgctgccccggctgggtgaatttcgccgagaagcacctccccgacatcctgccgcatgtctcgaccacacgctcgcctcagcagtgccttggcgcattggccaagacctatcttgcgcgcaccatgaacgtcgcaccggagaggatgcgcgtcgtatcgttgatgccctgcacggcgaagaaggaagaggccgcacggcccgaattcaggcgcgacggtgtccgggatgtggacgcagtgctcaccacgcgtgagttcgcccgtcttctccggcgtgagggcatagacctcgccggactcgaaccctcgccctgcgacgaccccctgatggggcgggcaaccggggcggctgtcatcttcggtacgacaggcggggtaatggaggcggcactgcgtacggtctaccatgtgctgaacggcaaggaactcgccccagtagaactgcatgccctgcgcggatacgagaacgtgcgtgaggctgtcgtcccgcttggtgagggtaacggttccgtgaaggtcgccgtggtgcatgggctcaaggctgcccggcagatggtcgaggcggttcttgcagggaaggccgaccatgtgttcgtggaggtcatggcatgcccgggtggatgcatggacggaggcggtcagccgaggtcgaagcgcgcctacaaccccaacgcgcaggcgcgacgtgccgcccttttctcgctcgatgcggaaaacgcactgcggcagtcgcacaacaatccgctcatcggcaaggtctacgaatcattccttggcgagccctgttcgaatttgtctcaccgtctgctgcacacccggtatggcgaccgcaagagcgaagtcgcctacaccatgcgcgacatctggcatgagatgacccttggcaggcgggtacggggcgactctgattga

SEQ ID NO: 98 - DNA, 1719 bp, Clostridium perfringens
atgaataaaataataatcaatgataagactatcgaatttgatggtgataagacgatacttgacttagcaagagagaatggatttgacattccagtgctttgtgagttaaaaaattgcggaaacaaaggacaatgtggagtttgtcttgttgagcaagaaggaaatgatagactattaagatcttgtgcaataaaagctaaagatggaatggttattaaaactgatagtgaaaaagtactagaagctagaaaagaaagagttgcagaacttttagatgagcatgagttcaaatgtggaccatgtaaaagaagagagaattgtgaattcttaaaacttgtaattaaaacaaaggcaagagctcacaaaccatttgtagttgcagataaatcagaatatgtagatgacagaagtaaatcaatagttttagatagaagtaaatgtgttaaatgtggtagatgtgttgcggcatgcagaacaagaactgctactaactcaataaaattccacagaattgatggagtaagattagtaggaccagaagaattaaaatgtttcgacgatacaaattgtttattatgtggacaatgtatagctgcttgcccagttgatgcattatcagaaaaatcacatattgaaagagttcaagaggcattaaatgatccagaaaagcatgtaatagttgctatggcaccagctgtaagaacatcaatgggtgaattattcaagatgggttatggacaagatgttactggaaaattatatactgctttaagagaattaggttttgataaagtatttgatataaacttcggtgctgatatgacaataatggaagaagctactgagcttatagaaagaataaaaaataacggacctttcccaatgttaacttcatgttgtccatcatgggttagagaagttgaaaactacttcccagaattagtagaaaatctttcatcagctaaatcaccacaacaaatatttggtgcagcatcaaaaacttattatccacaagttgctgatatagatcctaaaaaagtatttacagtaactgtaatgccttgtacttctaaaaaattcgaggctgatagacctgaaatggaaaacgaaggaataagaaatatagatgcagttataacaactagagagttagctagaatgataaaagctgctaaaatagattttgctaaattagaagatggtgaagtggatccagctatgggtgagtacactggagcaggtgttatatttggagctactggtggagttatggaagctgctttaagaacagctaaagatttcatggaaaatgacaacttagataatgtagattacgaagctgttagaggattagctggaataaaagaagctgaagtagaaatagcaggaaatgaatataaattagctgttgtaagtggagctgctaatgtatttgaactagttaagtctggtaaaataaatgactaccacttcatcgaagtaatggcatgtcctggtggatgtgttaatggtggaggacaaccacacatctcagctgaagatagtgataaaatggatattagagaagtaagagcttctgttctttacaatcaagataagaatttagagaagagaaaatcacatcaaaactcagctttattaaaaatgtatgaaagctacatgggtaaaccaggtcatggaagagctcatgagttattacacatgaaatataaaaaataa

SEQ ID NO: 99 - DNA, 1719 bp, Clostridium perfringens
atgaataaaataataatcaatgataagactatcgaatttgatggtgacaagacgatacttgacttagcaagagagaatggatttgacattccagtgctttgtgagttaaaaaattgcggaaacaaaggacaatgtggagtttgtcttgttgagcaagaaggaaatgatagactattaagatcttgtgcaataaaagctaaagatggaatggttattaaaactgatagtgaaaaagtactagaggctagaaaagaaagagttgcagaacttttagatgagcatgagttcaaatgtggaccatgtaaaagaagagagaattgtgaattcttaaaacttgtaattaaaacaaaggcaagagctcacaaaccatttgtagttgcagataaatcagaatatgtagatgacagaagtaaatcaatagttttagatagaagtaaatgtgttaaatgtggtagatgtgttgcagcatgtagaacaagaactgctactaactcaataaaattccacagaattgatggagtaagattagtaggaccagaagaattaaaatgtttcgacgatacaaattgtttattatgtggacaatgtatagctgcttgcccagttgatgcattatcagaaaaatcacatattgaaagagttcaagacgcattaaatgatccagaaaagcatgtaatagttgctatggcaccagctgtaagaacatcaatgggtgaattattcaagatgggttatggacaagatgttactggaaaattatatactgctttaagagaattaggttttgataaagtatttgatataaacttcggtgctgatatgacgataatggaagaagctactgagcttatagaaagaataaaaaataacggacctttcccaatgttaacttcatgttgtccatcatgggttagagaagttgaaaactacttcccagaattagtagaaaatctttcatcagctaaatcaccacaacaaatatttggtgcagcatcaaaaacttattatccacaagttgctgatatagatcctaaaaaagtatttacagtaactgtaatgccttgtacttctaaaaaattcgaggctgatagacctgaaatggaaaatgaaggaataagaaacatagatgcagttataacaactagagagttagctagaatgataaaagctgctaaaatagattttgctaaattagaagatggtgaagtggatccagctatgggtgagtacactggagcaggtgttatatttggagctactggtggagttatggaagctgctttaagaacagctaaagatttcatggaaaatgacaacttagataatgtagattatgaagctgttagaggattagctggaataaaagaagctgaagtagaaatagcaggaaatgaatataaattagcggttgtaagtggagctgctaatgtatttgaactagttaagtcaggtaaaataaatgactatcacttcatcgaagtaatggcatgtccaggtggatgtgttaacggtggaggacaaccacacatctcagctgaagatagtgataaaatagatattagagaagtaagagcttctgttctttacaatcaagataagaatttagagaagagaaaatcacatcaaaactcagctttattaaaaatgtatgaaaactacatgggtaaaccaggtcatggaagagctcatgagttattacacatgaaatataaaaaataa

SEQ ID NO: 100 - DNA, 1455 bp, Megasphaera elsdenii
atgcctgaatttcattcccgttttgaaaaaattgaccgtcgtgttcccattgatgaacacaactgtgccgttcaatttgacgtaacgaagtgtaagaactgcaccttatgtcgccgggcctgtgccgacacacagactgtgttggactactactccctgtccagtacaggggacatgcccatctgcgtacattgcggccagtgttcgtctgcctgcccctttggtgccatcgtcgaagtcaacgatgtggacaaagtcaaggcggccctgaaagaccctgaaaagatcgtcatcttccagacggctccggctgtccgcgtcggcttaggcgaagccttcggcatggaccccggtacgttcgtcgaaggaaagatggtcgcagccctgcgtacactcggtgcggactatgtcttcgataccgatttcggtgccgacctgaccatcatggaagaagcgacggaactcctgcaccgcctgcaatcggaagaaatccctattccgcagttcaccagctgctgcccggcatgggtcgaatttgcggaaaccttctatccggacctgctccagcatctgtcttcgacgaagagccccatcagtatcctcagcccggtcatcaagacctatttcgcccagcagaagaacatcgaccccaagaaaatcgtcaacgtctgcgttacgccgtgcacggcgaagaaagccgaaatccgccgtcctgaactgagcgcttccggcctcttctgggatgaaccggaaatccgcgataccgatatctgcatcacgacgcgggaactggcccagtggatccaggacgaaaacatcgactttgccagcctcgaagatagcaagttcgacaaggcttttggcgaagcctccggcggcggccgtatcttcggcaactccggcggtgtcatggaagcggctatccgcacggcataccacatgttcacaggccgtccggccccgaaggacttcatccccttcgaaccggtccgcggtctccagggcgtcaagaaagcgacggtcatcttcggccacttcgtccttcacgtcgctgccatcagcggcctgggcaacgcccgcgccttcatcgacgacctcattaagaatgacgcctttgaagactactccttcatcgaagtcatggcctgccccggtggctgcatcggcggcggcggtcagccgaaagtcaagctgccgcaggtcaagaaagtccaggaagcccgcacggcatcgatttataagagcgatgaagaaaccgatatcaaagccagctggcagaacccggaaatcgaaacactctacgaagctttcctcgatgaaccgctgtcagaaatggccgaatttaccttgcacacctacttctccgacaagagcgaccagctgggccgcatgaagaacctcacgccccagaccaaccccatgtcgccgaagtacaaacccccgacagaagaatag

SEQ ID NO: 101 - DNA, 1266 bp, Desulfovibrio desulfuricans
atgaacttggttgaaatggaaaagattcagtatgtggatcagtcgcctgacccgcgagcgaatccggatgaactttttttcatccagattgatccggaaaaatgtatcggctgcgatacctgtcaggagtattgcccgacgggcgccatatttggcgataccgggagtgcgcatagtattcctcatgaagaaatctgcatcaattgcgggcagtgtcttactcattgccctgtcggagccatttacgaggtgcagtcctgggttcgggagctgagtgaaaaaatcaaagatccggagatcaaggtaatcgccatgccggctcctgctgtccggtatgggcttggagaatgtttcggcatgccggtgggcacggtaaccacgggaaagatgctgacagctttgcagatgctgggctttgaccacgtatgggacaatgagttcaccgcagatgtcaccatatgggaagaaggcaccgagtttgtcaaccgccttacagggcagattgacaagccgcttcctcagtttacctcttgctgccccggatggcacaaatatgtggaaagcttttatcctgagttgttcccgcatctttcaagctgcaaatctcccatcgggatgatgggcgcactggccaaaacgtatggaccggatgtgatgaaatatgatcggtccaaggtttatacggtttccattatgccctgtaccgctaaaaagtatgagggcatgcgcgcggacctgtggtccagcggctacaaagacattgacgcaaccatagacacccgcgaactggcctacatgataaaaaaggcaggcattgatttcgccgctctgccggacggcaaacgggacacgttgatgggtgattccaccggtggggccacgattttcggtgtatccggcggtgttatggaagcggctttgcgttatgcctacgaagctgtgaccggcaaaaaaccgtcgagctgggattttacgatggttcgcggcctgaacggtatcaaagaaggtactgtcaccattggcgatgcaaagataaacgtggcggtggttcacggagcaaagcgttttgcggaagtatgcgaggtgattaagacagggaaaagcccgtggcatttcatcgagtttatggcctgccccggaggatgtgtctgcggtggcggtcagcctgtgatgcccggagtactggaagctatggaccgcaaagtttccagaacctttgccggactcaaagagcgtctgaacagaatgtcgtccagcaaggcatag

SEQ ID NO: 102 - DNA, 1758 bp, Desulfovibrio fructosovorans
atgtccatgctgacaataaccatagacggcaaaacgacgtcagtgccggagggcagcaccatcctggatgccgccaagacgctcgacatcgacattccgaccctgtgctacctcaacctggaggccctttcgatcaacaacaaggccgcctcctgccgcgtctgcgtggtcgaggtcgagggccggcgcaacctggccccgtcctgcgccaccccggtcaccgacaacatggtggtcaagaccaacagcctgcgcgtcctgaacgcccgccgcaccgtgctcgagctgctgctgtccgaccaccccaaggattgcctcgtgtgcgccaagtccggcgagtgcgagctgcagaccctggccgagcgcttcggcatccgcgagtcgccctatgacggcggcgaaatgtcccactaccgcaaggacatctccgcctccatcatccgcgacatggacaagtgcatcatgtgccgccgttgcgagaccatgtgcaacacggtccagacctgcggcgtgctctcgggcgtcaaccgcggcttcaccgccgtggtcgccccggccttcgagatgaacctggccgacaccgtgtgcaccaactgcggccagtgcgtggccgtgtgccccaccggcgccctggtcgagcacgagtacatctgggaagtggtcgaggccctggccaacccggacaaggtcgtcatcgtccagaccgccccggccgtgcgcgcggccctcggcgaggacctcggcgtcgcccccggcacctcggtcaccggcaagatggccgccgccctgcgtcgcctgggcttcgaccacgtcttcgacaccgacttcgccgccgacctgaccatcatggaggaaggctcggaattcctcgaccgcctgggcaagcacctggccggcgacacgaatgtcaagctgcccatcctcacctcctgctgcccgggctgggtcaagttcttcgaacaccagttcccggacatgctcgacgtgccctccacggccaagtcgccgcagcagatgttcggcgccatcgccaagacctactacgccgacctgctcggcatcccgcgcgaaaagctcgtggtcgtctcggtcatgccctgcctggccaagaagtacgagtgcgcccgtccggaattctccgtgaacggcaacccggacgtcgacatcgtcatcaccacccgtgagctggccaagctcgtcaagcgcatgaacatcgacttcgccgggctgcccgacgaggacttcgatgcgccgctcggcgcgtccacgggcgcggccccgatcttcggcgtcaccggcggcgtcatcgaggcggcgctgcgcaccgcctacgagctggccaccggcgaaacccttaagaaggtcgacttcgaggacgtgcgcggcatggacggcgtcaaaaaggccaaggtcaaggtcggcgacaacgagcttgtcatcggcgtggcccacggccttggcaacgcgcgggaactcttgaagccgtgcggcgcgggcgagaccttccacgccatcgaggtcatggcctgtccgggcggctgcatcggcggcggcggacagccctaccaccacggcgatgtggaactgctcaaaaagcgcacccaggtcctctacgccgaggacgcgggcaagccgcttcgcaagtcccacgagaacccgtacatcatcgaactctacgagaagttcctgggcaagccgctctccgaacgctcgcaccagctgctgcacacccactacttcaagcggcagcgcttataa

SEQ ID NO: 103 - DNA, 1266 bp, Desulfovibrio fructosovorans
atgagccgcatcgagatggcaaagatcttctacgaacagaccgtgccgcctccgggcacgaacctggaccaggcctatatcgtccaggtcgacgagaccaaatgcatcggctgcgatacctgcatgggctactgccccaccggggccatcaccggcgaatccggcgagccccacaaggtggtcgatccggccgcctgcatcaactgcggccagtgcctcacccactgcccggttgcggccatctacgagaccgtgtccttcgtcccggagatcgaagccaagctcaaggacaagaacgtcaaggtcatcgccatgccggccccggccgtgcgctacgccctgggcgatcccttcggcatgccgctcggcgcggtcaccaccgagcatatgctcacggggctcaagcagcttggcttcgacaacgtctgggacaacgagttcacggccgacgtcaccatctgggaagagggctccgagcttctggcccgcatcaccaaaaagctcgacaagcccctgccccagttcacctcctgctgtcccggctggcagaagtacgccgagaccttctaccccgagctgctgccgcacttctcctcgtgcaagtcgcccatcggcatgatgggtcccctggccaagacctacggggccaaggagctcggctacgagcccaagcagatctacaccgtgtccatcatgccctgcacggccaaaaaattcgaaggcatgcggccggagatggacgccagcggcttccgcgacatcgacgccaccatcaacacccgcgagctggcctacatgatgaaaaaggccggcatcgacctgccgaagatcgccaatggcaagcgcgacgcggtcatgggcgaatccacgggcggcgcgaccatcttcggcgtttccggcggcgtcatggaagcggccctgcgcttcgcctaccaggccctgaccaagaaaccgccccagagctgggacttcaaggccgtgcgcggcctaaacggcatcaaggaagccaccatcaacatcggcggcaccgacgtcaaagtggccgtggtcaacggcggcaagaacttcgccaaggtctgcgacgaggtgaaggccggcaaatcgccctaccacttcatcgagttcatggcctgcccaggcggctgcgtcatgggcggcggccagcccatcatgccgaccgtgctcgaatccatgaaccggaccaccacgaagttctacgcgtcgctcaaaaagcgtctggccctctacgacgcgcaaaaggcgtaa

SEQ ID NO: 104 - DNA, 1827 bp, Thermotoga maritime
atgaggaggttttttaaaaataatttgagaaatttatcacaaaatggtgaaaccaattctgtgaggaggtgctttgccttggcggacgtgacggttgttataaatggtagaacgctcacggtacctgacaacttgacggtcattgaagcctgtgaaaaggcgggaatagaaattcctgctttgtgtcaccatccaagactcggggaatcaataggtgcgtgtagagtctgtgtcgttgaggtggaaggagcgaggaatcttcaacctgcgtgtgtgacaaaagtgagagatggtatggtgataaagacctcctctgacagggtaaaaacagccaggaagttcaacctcgcgcttcttctctctgaacatcccaacgattgtatgacgtgtgaagcgaatggaaggtgtgagttccaggatctgatctacaagtacgatgtggaacccattttcggatacggtactaaagaagggttggtcgacaggagcagccctgctatagtcagagatctttccaaatgtatcaaatgccagcgctgtgttagagcatgttccgaacttcagggaatgcacatctactctatggtggagaggggccacagaacttatcccggcactcctttcgacatgcctgtttatgaaacagattgtataggttgtggtcagtgtgctgcgttctgtccaacgggtgctatagtcgaaaattcggcggtaaaggttgttctggaggaactggagaagaaggaaaagatcctcgttgttcaaactgcaccttcagtgagagtggcgattggcgaagaatttggatacgctcccggtaccatttctactggccagatggttgctgccctcagaagactcggtttcgattacgtcttcgacacgaactttggggcagacctcaccataatggaagaaggaagtgaatttctcgaaagactcgaaaaaggcgaccttgaagacctccccatgttcacttcttgttgtcctggttgggtgaaccttgtggaaaaggtctatcccgaactcagaacgaggctttcctctgccaagtctccacagggaatgctctccgctatggtgaagacctacttcgcggagaaactcggagtgaaaccggaagacattttccacgtgtccatcatgccctgtaccgcgaagaaggacgaggctctgagaaaacagctcatggtgaacggtgttccagcggtggatgttgttctcaccacaagggaacttgggaagctcataaggatgaagaagataccgtttgcaaaccttccagaggaagaatacgacgcaccgcttggaatctctacgggagcggcggcactctttggcgttacaggcggtgtgatggaggctgctttgagaactgcgtacgaactcaaaacgggaaaggcactaccgaagatcgtttttgaagaggtgagaggactcaaaggtgtcagggaagccgaaatagatctggatggcaaaaagataaggatcgctgtggttcacggtacagccaacgtgagaaatctggtggagaagattctgagaagagaagtgaagtatcatttcgttgaagtgatggcgtgtcccggcggatgtatcggtggaggaggccagccctacagcagggatccagagatcctcagaaagagggcggaagccatctacaccatcgacgagagaatgactctgaggaagtcccacgagaaccctgccataaagaagctgtacgaagagtacctcgaacatccgctcagtcacaaagctcacgagctgcttcacacctactacgaagacagatcaaggaagaaaagacttgcggtaaaataa

SEQ ID NO: 105 - DNA, 1938 bp, Thermotoga maritima
atgaaaatttacgttgatggaagagaagttatcataaatgacaacgagcgtaacctccttgaagcgctgaagaacgtggggatagagattccgaatctgtgttatctttcggaggcttctatatatggagcctgtagaatgtgtcttgtggagatcaacggtcagatcaccacttcctgtaccctgaaaccgtacgaaggtatgaaggtaaaaacgaacacccccgaaatatacgaaatgagaagaaacatcctcgaactcatcctcgcaactcacaacagggactgcaccacctgcgatagaaacggaagctgtaaacttcagaagtacgctgaagacttcggcataagaaagatcagattcgaggctctcaagaaagaacacgtcagggacgaatccgctccggtagtgagagatacatccaagtgtattctctgcggtgactgtgttcgcgtgtgtgaagaaattcagggagtcggtgttatcgagttcgcaaagcgcggttttgaaagcgttgtgacaaccgcttttgatactcccctcatagagacggagtgtgtgctctgcggacagtgtgtagcctactgtccaacgggagctctgagcatcagaaacgacatagacaagttgatcgaagctctcgaaagcgataagatcgtgataggaatgatcgcacctgcggtgagggctgcgattcaggaagagtttggaatagacgaagacgtcgcaatggcggaaaaactcgtctctttcctgaaaacgataggcttcgataaagtcttcgatgtgtcgttcggagcagaccttgtcgcctacgaagaagcccacgagttctatgaaagactcaaaaaaggagaaagacttccacagttcacctcatgctgtcccgcatgggtgaagcacgctgagcacacctatcctcagtaccttcagaatctctcgagcgtgaaatcacctcaacaggcactcggtacggtgataaagaagatctacgcaagaaaactcggtgttcccgaagaaaagatcttcctcgtttcgttcatgccgtgtaccgctaaaaagttcgaagcagaaagagaagaacacgaaggaatcgttgacattgtcctcacaacaagggaactcgctcaactcatcaagatgagcagaatagacataaacagagtagaaccccagccgttcgacagaccttacggagtgtcttcgcaggcgggtctcggttttggaaaagccggtggggtcttctcctgtgttctttctgtgttgaacgaggaaatcggcatagaaaaagtcgatgtaaaatctccggaagatggcatcagggtagcggaagttacactcaaagatggtacgtctttcaaaggagctgtcatatacggtcttggtaaggtgaagaagttcctcgaagaaagaaaagacgtggagattatcgaagtaatggcctgtaactacggatgtgtgggtgggggaggacagccttacccgaacgattccagaatcagagaacacagggcaaaagtgctaagagacaccatgggaataaaatctctcctcacacccgtggaaaacctctttctcatgaaactctacgaggaagatctgaaagacgaacacacaagacacgaaattctccacaccacctaccgaccgaggagaagatacccggaaaaagatgtggaaatactgcccgttccaaacggcgaaaagagaacggtgaaagtctgtcttggaacctcctgttacacgaaagggtcttacgagatattgaaaaagcttgtcgactacgtcaaagagaacgatatggaaggaaagatagaagtgctgggaacgttctgcgtggaaaactgcggtgcttctccaaacgtgatcgtggatgataaaatcataggtggtgccacttttgagaaggtgctggaggagctttcgaaaaatggctga

SEQ ID NO: 106 - DNA, 3621 bp, Nyctotherus ovalis
atgatttcaaggttaatagccaagaaggcccctcttttcttgagaaccttcgctacttccgagatgattagcctcaagatcgatggcaagatcatctctgttcctaaaggaataatgttggctgacgcaataaagaaggccggagcaaatgttccaacaatgtgctatcacccagatctgccaacttcaggaggcatttgccgagtgtgtttagtggaaagtgctaagtccccaggttaccctatcatcagctgcagaactccagttgaagaaggcatggaaatcgttactcaaggctctaaaatgaaggagtatcgccaagcaaatcttgccttgatgttgtctcgccatccaaacgcttgcctctcatgcacttcgaataccaattgcaagacccaagagctatcagccaatatgaatatcgggcagtgtgggttcgccaatgcaactccaccaaagaacgatgatagctatgacatgaccacagccattgaaagagataatgataaatgtattaattgcgatatctgtgttcatacttgctctcttcaaggtcttaatgcccttggtttctacaatgaagaaggtcatgccgttaaaagcatgggcacccttgatgtttctgagtgtattcaatgcggtcaatgcatcaaccgctgtcctactggagccatcacggagaagtcagaaataaggccagtgctggacgccatcaatatccaacaaagacttgttttccaaatggctccttctatccgtgttgccgtagctgaagaatttggtatcaaaccaggcgaaaaaatcttaaagaacgaaatagcaacagcattgcgtaagttaggatctaatgtatttgtgttggatacgaacttttcggctgacttgacaatcattgaagaaggccacgagttgattgaaaggctatatagaaacgttacgggaaagaaattgctgggtggcgatcatatgccaattgatcttccaatgctgacaagttgctgtcctggttggatcatgttcattgaaaagaactaccccgatttgcttaacaatctatcaacctgcaagagtccgcaaggaatgctaggagctttaattaaaggttactgggcgaaaaatattaagaagatggatcctaaagatattgtgagtgtttctataatgccttgcacagcaaagaaggccgaaaaggaaagaccacaattgagaggtgatgaaggatataaggacgtggattacatcctgaccacacgcgaattggcaaagatgttaaagcaatcaaatattgatcttgctaaaatggagccaacaccttttgataaggttatgagtgaaggaacaggtgctgccgttatctttggtgttactggtggtgttatggaagctgctctacgtactgccaatgaagtaattactggacgtgaagttcctttcaagaatctcaatattgaagcagtccgtggaatggaaggaattcgtgaagctggaattaaactcgaaaatgttcttgacaaatacaaggcctttgaaggagtaacagtgaaggtggcaatagctcatggaccaaataatgctcgcaaggttatggatatcattaaacaagctaaagaatcaggaaaaccggctccttggcactttgttgaagtcatggcttgtcccggcggatgcattggaggtggtggacagccaaagccaacaaatctagaaatacgccaagcaagaacccaattaacctttaaggaagatatggatctccctcttaggaaatcacatgacaatcctgagattaaagcaatctatgagaattacttgaaagagccattaggacataattcacatcattatcttcatacaacctacagctctcaaaaagtccgcgacatgaatctatacaacgccaatgaagccgcaggacttgatgaaatactagccaaatatcccaaagaaaaagaatacctgatgccaataataatagaggagcatgacaagaagggttacatttcagatccttcgattgtaaagatatcagagcatctaggaatgtatccagcacagattgagagcattctttcttcataccattacttcccacgtgagcacaccatcgcgattctcatgtctatatgtgtacattgccataattgcatgatgaaaggacaaggaagacttcttaagactattcaggaaacttacgatattcatgaaacgcatggaggagtagccaaggacggaagctttactctgcatactcttaattggttgggctattgcgtgaatgatgcaccagctatgatgattaagagaaagggaacaaactatgtggagacatttaccggacttctaggagataatattgatcagcgccttaaatctttgaagaacttgaagaaggagctacctaagtggccaaagaataatattcgggaaatgaagtcacaaagaaatggaaactcttactcttgcatgaatactcaagctcctatagctgaagcaactaagaaggcagtaagcatgggaccagagaaggttatagaggaagttttcaaatcaaatttggtgggacgtggaggagcaggatttagaactggcaagaagtgggagtcagcatacaaaactccagcgagtgataagtacgttgtatgcaatgcagacgaaggacttccctcaacctataaggattggtgcttactcaataatgaagcaaagagaaaagaagtatttactggaatgggaatttgcgctaagaccattggagctaagagatgcttcatgtacttaagatacgagtacagaaatttggttccagcacttgaacaatctataaaggatgtacaaagcacttgtcctgaacttgctgacttgaagtatgaaataagactaggtggtggaccttatgtggcaggtgaagaaaatgctcagtttgaatctattgaaggacgtgcaccacttccacgtaaagacagaccaggaaatattttccctacaatggaaggactgttccacaagccaacagtaataaacaacgtagagaccttctttgcaatcccgcacatcatccaacaaggctctcaaagtttcggtgaaggcaagatgcctaagctcttaagtgtcactggagatgtagacgagccaatccttatcgaaaccaatctcaacaactacagcctgaaccacctcttgcaagaaataagtgctaaggacattgtagcagcagaaattggtggatgcaccgagccaatcattttcggaagcaagtttgatacactgtttggattcggaaggggaactttgaatgcagtgggatcagtagtattgtttaactcaagctgtgaccttggtaagatatatgagaacaagttgaagttcatggctgaggagagttgcaagcaatgtgtaccttgccgtgatgggtcttacatcttccacagagctttcaaggaactcagagataccggcaagagttcgtacaacatgagagcgcttgcagttgcttctgagtctgcagctaggtcttctatatgcgctcatggtaaggctctggaaagcttattcaaatctgcatgtgacttcatgaacaagactaaaccaatctattaacctcactctacataccatcagttc

SEQ ID NO: 107 - DNA, 1404 bp, Spironucleus barkhanus
atgaaggtaagatagtctccttttaagatcgatattacaaatggaccaattgaccgcaatgacgccatttagattgattatcaaaaatgtattggatgttagatgtgcgctaaaacatgcacggattcataaaattttaatatctttaagatctctgctcctaaaacaaaaccttttgttaatgcatatggttcagttgccgaaggaactgaaagaaatgccctcgcaggaactgactgcacaggttgtggtgcttgtgtacgtgcttgccctgttgaggcattaatgcctgcttttaatataagaccagttttagaaccaatcagcgagaagaagaaggttactatagctgtcattgctcctagtacccgtgtaggactggctgaaggaatgggcatgggtgtcggtgttacggcagaaagataaatggtttatgaactcaaatagatgggatttgactacgtatttgataatatgtggggagctgatgcccctaccactgaagatgctaaagagatccttaaggcgaaagcagcaggtaaaactgcttttacctcatgctgccctgcatgggttaagcttgtagagactacttatcctgaattgcttcctaatatttctagtgctcgttctcctcatggcattatttgctctgttattaagaaatactttgctaaggatattggcaaaaaggcagatgaactttacgtagttggtgttatgccatgcactgctaagaaaaacgaagcagcaagaaaagagctcactactgatggatccccagattgtgatatctctataactacaagagagttaatggcttatctcaaagagaaaaaagttactttttcggctgcacgcgagatagaattaaaagacaacgtgtaggcataatatgatgctccatttaatacattttcaggatctgcttatatttatggcaaaactgctggtgttactgaagctgttgtgcgctatgtgtgtgcaataaagaaagttcccttttcagtgggcatgataactaaagagttaatttgggaaaataaactccattcatcatcgctcaccttgttaaccttcagtgcagcaggcgaagactatagaatttgcgtatcatacggtggtttagcagctcataaagcagttgaattatacaagagtggtgaattaaaagtggatgccgtagaagtaatggtttgccctggcggttgcgtaggaggaggtggccaaccaaaataacctaagaaagatatgatacttaagagacacgaaggtcttgacaagcatgacaaagaggctccttactcaaattgtactgagaaccctacactcaatgagttttatgaaagaattggcactgatgtacaccatgttatgcacaccacttattctgcatataaatga

SEQ ID NO: 108 - DNA, 1407 bp, Trichomonas vaginalis
atgttagcgagttcagcaacagcaatgaaaggatttgcaaatagtctcagaatgaaagactatagctcaacaggtatcaattttgatatgacaaaatgcataaattgccaatcatgtgtcagagcatgcacaaacatcgcaggtcaaaatgttcttaagtctttaacagtcaatggtaaatcagtggtacagacagttacaggaaaaccacttgcagaaactaattgcatctcatgtggacagtgtacgttaggttgtccaaagtttactatctttgaagctgacgcaattaatccagtgaaggaagttcttacaaagaaaaacggaagaattgcagtttgccaaattgcacctgcaatcagaattaatatggcagaagccctaggtgttccagctggaacaatctcattaggtaaggttgttactgcattaaagcgtcttggctttgattacgtctttgatacaaactttgcagcagatatgacaattgttgaagaagcaacagaattagttcagcgtctctcagacaaaaacgccgttcttccaatgtttacatcatgctgtcctgcttgggtaaactatgttgagaaatcagatccatctctgattccgtacttaagctcatgcagatctccaatgagtatgctttcttctgtaatcaaaaatgtgttcccaaagaagattggaacaacagctgataagatttataacgttgctattatgccatgcacacgaaagaaggatgaaatccaaagatcacaattcacaatgaaagatggaaagcaagagacaggtgcagtcttaacatccagagaattagccaagatgatcaaagaagcaaaaatcaacttcaaagagttaccagatacaccatgcgataacttctactcagaggcttctggtggtggtgcaatcttttgtgcaactggtggtgttatggaagctgcagttcgttctgcttacaaattcttgacaaagaaggaactcgcaccaattgaccttcaagatgttcgaggtgttgcaagtggtgtcaaacttgctgaagttgatattgcaggtacaaaagtcaaagttgcagttgctcacggcataaagaatgcaatgactttgatcaaaaagatcaaatctggtgaggaacaatttaaagatgttaagtttgttgaagtcatggcttgtccaggcggctgtgttgttggcggtggttctccaaaggccaagacaaagaaagctgttcaagccagactcaacgctacatattctattgataaatcatcaaaacatagaacatctcaagacaatccacagcttttgcaattgtacaaggaatcgttcgagggtaagtttggtggccacgtagctcaccaccttttacacactcattacaagaacagaaaagttaatccatag

SEQ ID NO: 109 - DNA, 1350 bp, Trichomonas vaginalis
atgctcgcatcatcctcacgtgctgcagccaatatccgctgggttgatacatcccataatgctattgcctttgatatgcacaagtgcatcaattgccaagcttgtgtccgtgcatgcaagaatgtcgccggccaatccgtcctcaaatctgtcaagattaatgaaggaaagaagaagggtgtagtccaaacagttacaggcaaattacttgctgagacaaactgcatcggctgtggccaatgtacacttgtttgcccaacacaggccatccatgaaaaggatgccctcaaacagatgaacaacattttcaagaacaagggtgaccgtatccttgtctgccagattgctccagccatccgtatcaacatgcgaaggccttggtgttccagtcggaacagtttccacaggcaaagtcgttacagccctcaacgtctcggtttcgactacgttttcgatacaaacttcggtgccgatcttacaatcgtcgaagaagccacagaactcctccaacgtctcaacgatccaaaggccgttcttccaatgttcacatcttgctgccctgcttgggtcaattacgttgaaaagtcatatccacaatggatgccacatctttcaacatgccgttctccaattggtatgctttctgctgtcatcaagaacgtcttccctaagcacatcggtgttgatccaaagagaatcttctctgttggtattatgccatgcacagccaagaaggatgaagccgctcgtgagcagctcatgacaaagtctggccttcacgagacagatcttgatattacatctcgcgaactcgccaagatgatcaaggccgctaagatcaacttcaaggaactcccagacacagaacttgactcaccatacgctatggctacaggtggtggtgctatcttctgcgctacaggtggtgttatggaagctgccgtcagatccgcttacaaattcgctacaggaaaggaactcgctccaattgagttcgtccaagtccgtggcgctgagaagggcatcaaggttggcacagtcgacatcaatggtcgtgagattaaggttgctgtcgcccagggtgtcaagaatgctatgagccttatcaagaagatcgaagaaggccaggatgatgtcaagggtgtcgtcttctgcgaagttatggcttgcccaggtggctgtgttggtggtggtggttcaccacgtgctaagacaaaagccgcgatgaacaagcgtcttgatgctacatacagaattgacagagcttccaagtacagaacaccacaagataatacacaactccaggatctttacaacgctacttgggtggtaagtttggtcatggattag

SEQ ID NO: 110 - DNA, 1770 bp, Trichomonas vaginalis
gcctcaactggcattaattccacagcaaacattctccgtaacatcactgttacagtcaatggtaagccattagaagcaaagaagggtgaaacagtcctcgaactttgcgaccgcaacaacatcagaatcccaagactttgcttccatccaaaccttccaccgaaggcttcctgccgtgtctgccttgtcgaatgcgatggcaagtggctctccccagcttgcgttacaacagtttgggatggtctcaagatcgacacaaagtccaagaacgttcgcgactccgttgagaacaacctcaaggaactcctcgactgccacgatgaaacatgctcagcttgcattgctaaccacagatgccagttccgtgacatgaacgtcgcctactccgtcaaggccgagacaaaggagatctgctccgaggaaggcattgatgaatccacaaacgctatccgccttgatacatccaagtgcgtcctttgtggccgttgcatccgtgcttgcgaagaagtcgccggcacatccgccatcatcttcggcaaccgtgccaagaagatgagaatccagccaacattcggtgtcacacttcaggaaacatcctgcatcaagtgcggccaatgcacactttactgcccagtcggtgccatcacagagaagtcccaggttaaggaggccctcgacatccttgctaacaagggtaagaagatcacagttgtccaggttgctccagccgttcgtgttgccctctctgaagctttcggctacaaggaaggtacagtcacaacaggcaagatggtctctgctctcaaggccctcggcttcgacctcgtttacgatacaaactacggtgcagatcttacaatctgtgaagaagctggtgaacttgtcaaccgccttagagatccaaacgccaagttcccaatgtttacaacctgctgcccagcctgggttaactacgtcgagcagtccgctccagacttcattccaaacctttcatcctgccgctcaccacaaggcatgctttctgctttgatcaagaactaccttccaaagcttcttgacgtcaagcaggaggatgtccttaacttctccatcatgccatgcacagccaagaaggatgaagttgagcgcccagaactccgcacaaagtctggcctcaaggaaacagacatggttctcacagttagagaacttgtcgagatgatcaagctctccaacatcgacttcaacaaccttccagatacacagttcgataacatcttcggcttcggctctggtgctggccagatcttcgctgccacaggtggtgttatggaagctgcctcaagaacagccttcgaagtctacacaggcaagaagctcacaaacgtcaacatttacccagtcagaggtatggacggactcagaatcgctgagctcgacctcgatggtacaaagctcaaggtcgctgtctgccacggcattgctaacacagctaagctcctcgacagactccgcgagaaggatccagaactcatggatatcaagttcatcgaaatcatggcctgcccaggtggctgcgtctgcggcggtggcacaccacagccaaagaacagagtctctcttgataacagacttgctgctatctacaacatcgatgctaagatggaatgcagaaagtctcacgagaacccactcatcaagggagtctacaaggagttcctcggcaaaccaaattcacacctcgctcacgaacttctccacacacacttcaagcaccatccaaagtggtaa

SEQ ID NO: 111 - DNA, 1749 bp, Trichomonas vaginalis
atgaaaacaataatcttaaatggcaatgaagtgcatacagataaagatattactatccttgagctagcaagagaaaataatgtagatatcccaacactctgctttttaaaggattgtggcaattttggaaaatgcggagtctgtatggtagaggtagaaggcaagggctttagagctgcttgtgttgccaaagttgaagatggaatggtaataaacacagaatccgatgaagtaaaagaacgaatcaaaaaaagagtttcaatgcttcttgataagcatgaatttaaatgtggacaatgttctagaagagaaaattgtgaattccttaaacttgtaataaagacaaaagcaaaagcttcaaaaccatttttaccagaagataaggatgctctagttgataatagaagtaaggctattgtaattgacagatcaaaatgtgtactatgcggtagatgcgtagctgcatgtaaacagcacacaagcacttgctcaattcaatttattaaaaaagatggacaaagggctgttggaactgttgatgatgtttgtcttgatgactcaacatgcttattatgcggtcagtgtgtaatcgcttgtcctgttgctgctttaaaagaaaaatcccatatagaaaaagttcaagaagctcttaatgaccctaaaaaacatgtcattgttgcaatggctccatcagtaagaactgctatgggcgaattattcaaaatgggatatggaaaagatgtaacaggaaaactatatactgcacttagaatgttaggctttgataaagtatttgatataaactttggtgcagatatgactataatggaagaagctactgaacttttaggcagagttaaaaataatggcccattccctatgtttacatcttgctgtcctgcatgggtaagattagctcaaaattatcatcctgaattattagataatctttcatcagcaaaatcaccacaacaaatatttggtactgcatcaaaaacttactatccttcaatttcaggaatagctccagaagatgtttatacagttactatcatgccttgtaatgataaaaaatatgaagcagatattcctttcatggaaactaacagcttaagagatattgatgcatccttaactacaagagagcttgcaaaaatgattaaagatgcaaaaattaaatttgcagatcttgaagatggtgaagttgatcctgctatgggtacttacagtggtgctggagctatctttggtgcaaccggtggcgttatggaagctgcaataagatcagctaaagactttgctgaaaataaagaacttgaaaatgttgattacactgaagtaagaggctttaaaggcataaaagaagcggaagttgaaattgctggaaataaactaaacgttgctgttataaatggtgcttctaacttcttcgagtttatgaaatctggaaaaatgaacgaaaaacaatatcactttatagaagtaatggcttgccctggtggatgtataaatggtggaggtcaacctcacgtaaatgctcttgatagagaaaatgttgattacagaaaactaagagcatcagtattatacaaccaagataaaaatgttctttcaaagagaaagtcacatgataatccagctattattaaaatgtatgatagctactttggaaaaccaggtgaaggacttgctcacaaattactacacgtaaaatacacaaaagataaaaatgtttcaaaacatgaataa

SEQ ID NO: 112 - DNA, 1494 bp, Chlamydomonas reinhardtii
atgtcggcgctcgtgctgaagccctgcgcggccgtgtctattcgcggcagctcctgcagggcgcggcaggtcgccccccgcgctccgctcgcagccagcaccgtgcgtgtagcccttgcaacacttgaggcgcccgcacgccgcctaggcaacgtcgcttgcgcggctgccgcacccgctgcggaggcgcctttgagtcatgtccagcaggcgctcgccgagcttgccaagcccaaggacgaccccacgcgcaagcacgtctgcgtgcaggtggctccggccgttcgtgtcgctattgccgagaccctgggcctggcgccgggcgccaccacccccaagcagctggccgagggcctccgccgcctcggctttgacgaggtgtttgacacgctgtttggcgccgacctgaccatcatggaggagggcagcgagctgctgcaccgcctcaccgagcacctggaggcccacccgcactccgacgagccgctgcccatgttcaccagctgctgccccggctggatcgctatgctggagaaatcttacccggacctgatcccctacgtgagcagctgcaagagcccccagatgatgctggcggccatggtcaagtcctacctagcggaaaagaagggcatcgcgccaaaggacatggtcatggtgtccatcatgccctgcacgcgcaagcagtcggaggctgaccgcgactggttctgtgtggacgccgaccccaccctgcgccagctggaccacgtcatcaccaccgtggagctgggcaacatcttcaaggagcgcggcatcaacctggccgagctgcccgagggcgagtgggacaatccaatgggcgtgggctcgggcgccggcgtgctgttcggcaccaccggcggtgtcatggaggcggcgctgcgcacggcctatgagctgttcacgggcacgccgctgccgcgcctgagcctgagcgaggtgcgcggcatggacggcatcaaggagaccaacatcaccatggtgcccgcgcccgggtccaagtttgaggagctgctgaagcaccgcgccgccgcgcgcgccgaggccgccgcgcacggcacccccgggccgctggcctgggacggcggcgcgggcttcaccagcgaggacggcaggggcggcatcacactgcgcgtggccgtggccaacgggctgggcaacgccaagaagctgatcaccaagatgcaggccggcgaggccaagtacgactttgtggagatcatggcctgccccgcgggctgtgtgggcggcggcggccagccccgctccaccgacaaggccatcacgcagaagcggcaggcggcgctgtacaacctggacgagaagtccacgctgcgccgcagccacgagaacccgtccatccgcgagctgtacgacacgtacctcggagagccgctgggccacaaggcgcacgagctgctgcacacccactacgtggccggcggcgtggaggagaaggacgagaagaagtga

SEQ ID NO: 113 - DNA, 1248 bp, Chlorella fusca
gcagggccaacatctgagtgtgattgtcctccaacacctcaggccaagctgcctcactggcagcaggctctggatgagctcgccaagcccaaggagagcaggaggttgatgatcgcgcaaatcgcctccgctgttcgtgtcgctattgctgagaccattggcttggccccaggagatgtcaccattgggcagctcgtgactgggctgcgtatgcttggctttgattatgtctttgacaccctgtttggtgctgacctgaccattatggaggagggaacggagctgctgcatcgcctgcaggaccatctggagcagcaccccaacaaggaggagccactgcccatgttcaccagttgctgcccaggctgggttgccatggttgaaaagagcaatcctgagctcatcccctacctgtcatcttgcaagtcgcctcagatgatgcttggggccgttatcaagaactactatgcacagcaggttggagtgcagcccagtgacatctgcaacgtgtcagtcatgccatgcgtacgcaagcagggagaggctgaccgggagtggttcaacaccacaggtgcaggccttgcccgtgatgttgatcatgtggtgactactgctgaggttggtaagatattcctggagcgtggcatcaagctgaatgagctgccagagagcaactttgacaaccccattggcgagggcacaggtggtgctctgctgtttggcaccactggaggtgtcatggaggcagcacttcgcacagtctatgaagtggtgacccagaagcccatgggtcgtgttgactttgaggaggtgcgaggccttgaaggaatcaaggaggcagagatcacactcaagccaggagacgacagcccattcaaagccttcgcaggagctgatgggcagggcatcacgctcaagattgcagtagccaatgggcttggcaatgccaagaagctcatcaagagcctgtcagagggcaaggccaagtatgatttcattgaggtcatggcatgccctggtggctgcattggcggaggcggtcagccccgcagtactgacaagcagatcctgcagaagcgccagcaggctatgtacaacctggatgagcgcagtaccatccgccgcagccatgataacccattcatccaggcgctgtatgacaagttcctaggcgcacccaacagccacaaggcacatgatctgctgcacacacactatgtggcaggtggaattccagaggagaagtga

SEQ ID NO: 114 - DNA, 1518 bp, Chlamydomonas reinhardtii
atggcgcttggtcttcttgccgagctgcgcgcgggtcaggccgtggcatgtgctcgccgcaccaatgcccctgctcaccctgcggcagtggtgccctgcctgcctagccgtgcgggcaagttcttcaatctaagtcagaaggtcccttcgtcgcagtctgcgcgcggctcgaccattcgtgtggcagcgaccgcaactgatgctgttccgcactggaagctcgcgctcgaggagcttgacaagcccaaggatggcggccgcaaggtcttgatcgcgcaagtggccccggccgtccgcgttgccattgctgagtcattcggcctggccccgggtgccgtgtcgccgggcaaactagccaccggcttgcgtgccctcggcttcgaccaggtgtttgacacgctgttcgcggccgacctgaccatcatggaggagggcacggagctgctgcaccgcctcaaggagcacctggaggcccacccgcactccgatgagccgctgcccatgttcaccagctgctgccccggctgggtcgccatgatggagaagtcctaccctgagctcattcccttcgtcagctcctgcaagagtccccagatgatgatgggcgccatggtgaagacctacctgtccgagaagcagggcatccccgccaaggacatcgtcatggtctccgtcatgccttgcgtgcgcaagcagggcgaggctgaccgcgagtggttctgtgtgagcgagccgggcgtgcgcgacgtggaccacgtaatcaccaccgccgagctgggcaacatcttcaaggagcgtggcatcaacctgcccgagctgcccgacagtgactgggaccagccgctgggcctgggctccggcgccggcgtactgttcggcaccaccggcggcgtcatggaggcggcgctgcgcacggcctacgagatagtgaccaaggagcccctgccgcgcctcaacctgagcgaggtgcgcggcttggacggcatcaaggaggcgtccgtgacgctggtccccgctccgggctccaagttcgccgagctggtggcggagcgcctggcgcacaaggtcgaggaggcggccgcggctgaggcggcggcggcggtggagggcgccgtgaagccgcccatcgcgtacgacggcggccagggtttctccacggatgacggcaagggcggcctgaagctgcgggtggcggtggcgaacggcctgggcaacgccaagaagctgatcggcaagatggtatctggcgaggccaagtacgacttcgtagaaatcatggcctgccctgccggctgcgtgggcggcggcggccagccccgctccaccgacaagcagatcacccagaagcggcaggcggctctgtacgacctggacgagcgcaacacgctgcgccgcagccacgaaaacgaggcggtcaaccagctgtacaaggagttcctgggcgagcccctgtcccaccgcgcccacgagctgctgcacacccactacgtgccaggcggcgccgaggccgatgcttag

SEQ ID NO: 115 - DNA, 1212 bp, Scenedesmus obliquus
ccgcactggcagcagacgctggatgagctagccaagcctaaggagaggaaggtgatgatcgcccagatcgcaccagcagtgcgtggcattgcagagaccatgggcctcaatcctggggatgtgacagttggccagatggtgaccggcctgcgcatgctgggctttgattatgtgtttgacacgctgtttggtgctgacctcaccatcatggaggagggcacagagctgctgcacaggcttcaggaccacctggagcagcaccccaacaaggaggagccgctgcccatgttcaccagctgctgccccggctgggtggccatggtggagaagtcaaaccccgagctcatcccctacctgtcttcctgcaagtcaccccagatgatgctgggcgcagtcatcaagaactactttgcagccgaggccggcgccaagcccgaggacatctgtaacgtgagcgtgatgccctgcgtgcgcaagagcggcgaggccgaaccgcgaagtggttcaacacaccacagggctggacgacgcgacgtggaccatgttatgacgacagccgagctgggcaagatctttgtggagcgcggaatcaagctgaacgagctgcaggagtcgccgtttgacaaccccgtaggcgagggcagcggcggcggcctgctgtttggcaccactggcggcgtgatggaggcggcgctgcgcaccgtttacgaagtggtcacagcagaagcccttggaccgcagcgatcgtctttgacgacatccacggcctggaccccagcacaacgggcctcgccacgaccctcaccccaggccccaacagccccttcaaggcctttgcaggcgcagacggagtccggcatcaccctcaacattgctgtcgccaacggcctcggcaacgccaagaagctcatcaagcagctggctgcaggcgagagcaagtacgacttcaccgaggtcatggcctgccccggcggctgcatcggcggcggcggccagccgcaacggaacaaacagatcctgcagaagcgccaggcggcgatgtatgacctggacgaacgcgcggtgatccggcgcaccgagaacccgctgattggtgcgctgtatgagaagttcctgggagagcccaacggccacaaggcgcacgagctgctgcacacgcattacgtggccggcggcgtgcccgaccggagaagtgaaggggaagcttggtga

SEQ ID NO: 116 - DNA, 1746 bp, Thermoanaerobacter tengcongensis
atggacaaagttcgcgttacaatagatggcataactgtagaagtgccttcctactatacggtactggaagcggcaaaagaagccggcatagacatacctactctttgctatttgaaagagataaatcaaattggggcttgtcgcatatgtctagttgagatagagggagtaaggaatttacagacttcctgcacctaccccgtgtttgatgggatgaaagtctataccaatactccaaagataagggaagctcgcaggctaaatcttgaactcatactgtcaaatcatgatagaaactgcttgacctgcgtaagaagcaccaattgtgagcttcaagcccttgctaaaagacttggagtagaggaaataaggtttgaaggggaaaatataaaataccctatagatgatgcctcccctgcagttgtgagagaccctaataagtgtgtgctctgcagaagatgtgttgcagtgtgctcagaagttcagaatgtatttgctattggaatggtaaacagaggatttaagacaatggtagctccatcttttggaagaagcttaaaggattcaccctgtattagctgtggccagtgcataatggtatgtcctgttggagctatatacgaaaaagaccatacaaagagggtttatgaagctttggcagatgacaaaaaatacgttgtagctcagactgctccagctgtaagggtagcattaggagaagagtttggaatgcctgttggtaccattgtcacagggaagatggcagcagcactgaggagaatgggatttgatgcggtatttgatacaaactttgcagcagacctcacgataatggaagagggttctgagcttttagagagaataaaacatggcggaaagcttcctatgataacctcctgcagccctggctggatagctttctgtgagaagtactatccggagtttatagacaatctctccacctgcaaatctcctcacatgatgatgggggcactggtaaagagctactacgcggagaaaaaagggcttgaccctaaagatatattcgtagtgtcaataatgccatgtacagcgaagaagcttgagattgaaagagaagagatgataagaaatggaatgaaagatgtggatgccgtgcttaccacaagagagcttgcgagaatgataaaagagatgggaatcgattttgtgaacttaaaagatgaagaatttgatgagcctttaggcatgtctacaggagcaggtgccatatttggggctacaggcggtgtcatggaggcagcattaaggactgtcgctgaaattgtagagggaagagatatagggaagatagattttgaagaagtgagaggtttagaaggtgtgagagaggctacaataacaattgacgggatggatataaagattgctattgccaatggaacaggaaatgctaagaagctccttgacaaggtaaaggcaggagaagtcgagtatcactttatagaagtgatgggatgcccaggtggctgtataatgggtggaggacagccaatccacaatcctaacgagatggaagaagtcaagaaattaagggcaaaggcaatttacgagatagacaagaacctgcctataagaaagtcccacgagaacccggcgataaagaggctttacgaggaattcctgggttatcctttgagcgagaaatcccacgaacttctgcacacccactattcaagaaaagagctttatcctctcgtgaaataa

SEQ ID NO: 117 - DNA, 1821 bp, Clostridium thermocellum
atggcgtttgtatggagaaatgtccgttcaaggccatttccaaaaaagcctaatggaaggggatgtgaaaagatgcaaatggtaaatgttactatagataattgcaagatacaggtacctgccaattataccgtgttggaagctgcaaaacaggctaacatagacatacctactctttgcttcctcaaggatataaatgaagtaggtgcctgccgtatgtgcgttgttgaggtaaaaggtgccagaagcttacaggcggcctgtgtatatccggtgtccgaaggtcttgaggtgtacactcagacaccggcggtaagggaagccaggaaagtgactttggaacttatactgtcaaaccatgaaaagaaatgtttgacctgtgtaagaagtgaaaactgcgaattgcaaagactggcaaaagatctgaatgtaaaagatatcagatttgaaggtgaaatgagcaatttgccgatagatgatctttcgccttctgttgtaagggatcccaacaagtgtgttttgtgcagacgctgtgtcagcatgtgcaagaatgttcagaccgttggagccattgatgttactgaaagaggattccgtaccaccgtatcaacggcctttaacaaacctctcagtgaagtaccctgcgtaaactgcggacagtgtatcaatgtatgtcctgtgggagcattgagagaaaaggacgatattgacaaggtttgggaagctcttgcaaatcctgagcttcatgtagtcgttcagacggctcctgcagtcagggttgcattgggagaagagtttggaatgcctatcggctcaagagtgaccggtaaaatggtggcagcattgagtcgactgggctttaaaaaggtatttgatacagatacggctgccgaccttacaataatggaggaaggtactgagcttataaacaggattaaaaacggcggcaagcttcctttgataacttcctgcagcccgggatggataaagttctgcgaacacaactatcctgagtttttagacaatctgtccagctgcaaatcgcctcacgaaatgtttggtgcggttttgaaatcctactatgcacagaaaaacggaattgatccttcaaaagtatttgttgtatcaataatgccatgtacggcaaagaagtttgaggctcaaaggccggagctttcttcaacgggttatcctgatgtggatgttgttcttaccacaagagagcttgcaagaatgataaaagaaacgggtattgattttaattcccttccggataaacagtttgatgatcctatgggtgaggcatccggagcaggtgttatttttggtgccaccggaggagttatggaggctgccatcaggaccgtcggtgaattattgagcggcaaacctgcagacaagattgaatatactgaggtaagaggtcttgacggtataaaagaggcttccatagaacttgacggttttactctgaaggctgctgttgcccatggtcttggcaacgcaagaaagcttcttgacaaaataaaagccggagaggcggattatcatttcattgaaataatggcctgtcccggtggttgtataaacggtggaggacagcccatacagccgtcatctgtgagaaactggaaagatataagatgcgagagggcgaaagctatttacgaagaggatgagtccttgcctataagaaaatctcatgaaaatccaaagataaagatgctgtatgaagaattctttggtgaaccgggcagtcataaagctcacgagcttttgcacactcattatgagaagagggaaaactaccctgttaaatga

SEQ ID NO: 118 - DNA, 1911 bp, Neocallimastix frontalis
atgtctatgttatcatcagtattaaataaagccgtagttaacccaaagttaactcgttctttagctacagctgctgctgaaaagatggtcaatatttctattaatgggcgtaagttccaagttaagccaaaaactaccgttcttgaagctgccaaagctaatggttattatattccaaccttatgttaccaccaagaattaccagttgctggtaactgtagactttgcttagtttatgcgaagggttcatggaagccattaactgcttgtactactgaagtttgggaaggtatggaaattgaaactgattctccagctgttattgaaactgttagatccagtttatcaatgatgcgtgaagaacacccaaatgattgtatgacttgtggatcaaatggtgattgtgaattccaagatttaatttacagataccaaattgatgctaaacatccagtcagaagtcttcttaaacacaaatctaaaaagaccaaccatagtattactgaaccatgttattctccatttgataacactactttttccgttgctagagatatgaacaaatgtgttaagtgtggacgttgtattagagcttgccaccacttccaaaacattaatattttaggttttattaaccgtgctggttacgaacgtgtcggaactccaatggatagaccaatgaatttcacaaagtgtgttgaatgtggtcaatgttcacaagtttgtccagttggtgctattactgcaagaactgaagttgtggatgtcttaagacatttggatactaagagaaaggtagttgtttgttctactgctccagctattagagttgcacctgctgaagaattcagcactgaagctgactttgatttcactggtaagatggtagccggtttacgtaaacttggttttgattacattttcgatactaatttctctgctgatcttacaattatggaagaaggtactgaattaattgatcgtttaaataatggtggtaaattcccaatgttcacatcatgttgtccaggttggattaatatggttgaaaagagttacccagaattaagtgataacctttcttcttgtaagtctccacaacaaatgattggtgctgttattaaatcctactttgctaagaagttaggtttaagtactgaagatattattcacgttagtattatgccatgtactgctaagaagggtgaagctagacgtccagaatttgtacaaaagggtaaagatggtaaggattatccagatattgattacgtcatcactactcgtgaattattaactttattaaagcttaagaagattaatccagctgaacttccagatgataagtttgatagtccattaggtattggttcatctgctggtaatttattcggtgttactggtggtgttatggaagctgctattcgtactgctcaagttattactggtgttgaaaatccaattccattaggtgaattaaaggctattcgtggtcttgatggtattaaggctgctaacgttccattaaagactaaggatggtaaggaagttagcgttcgtgctgctgttgttagtggtggtgccaatatccaaaaattcttggaaaagattaagaacaaggaacttgaatttgattttattgaaatgatgatgtgcccaggtggttgtattaatggtggtggtcaaccaaaatctgctgatccagaaattgttgctaagaagatgcaacgtatgtacactatggatgatcaagctaaacttcgtttatgtcatgaaaaccctgaaattattgatgtttacaagaacttccttggtgaaccaaatagccatcttgctcatgaattattacatactcattataatgatcgttcaaagactattcatgatatgggtcatcatgaaaagaagtaa

SEQ ID NO: 119 - DNA, 1668 bp, Piromyces sp. E2
tgtttagttgatgttaagggttcatggaaacctttaactgcttgtactactgaagtttgggaaggtatggaaattgaaactgatactccagctgttagagaaactgttagatccagtttagctatgatgcgtgaagaacatccaaatgattgtatgacttgtgaatctaacggtaactgtgaattccaagatttaatttacagataccaaatcgatgctcaacatccagttagaactcttcttagaaacaaatttaagaagaccaaccatagcattaccgaaccatgttactcaccatttgatgactctactttttctatttctagagatatgaacaagtgtgtaaagtgtggtcgttgtgtcagagcttgtcaccacttccaaaatattaatatcttaggtttcattaaccgtgctggttatgaacgtgttggtactccaatggatagaccaatgaacttcactaagtgtgttgaatgtggtcaatgttctcaagtttgtccagttggtgctattactgaaagaaatgaatgtattgaagttttaagacacttagatactaagagaaagattgttgttgtttctacagctccagctattagagttgctcttgctgaagaattcaacgctgaaccagactttgatttcactggaaagatggttgctggtttaaagaagcttggtttcgattacatattcgatactaacttctctgctgatcttaccattatggaagaaggtactgaattaattactcgtttgaacgaaggtggtaaattcccaatgttcacttcatgttgtccaggttggatcaatatggttgaaaagagttacccagaaatccgtgataacctctcttcttgtaagtctccacaacaaatgattggtgctgttatcaagacatactttgctaagaagattaatgctaaaccagaagatattattcatgttagtgttatgccatgtactgcaaagaagggtgaagctaagcgtccagaatttaagagagatggtgttccagatattgatcatgtcattactacccgtgaattaattactttattaaagcttaagagaattaacccatctgaacttaagaacgaaaagttcgacagtccattaggtattggttcttctgctggtaatttattcggtgttactggtggtgttatggaagctgctgttcgtaccgctcaaattatcactggtgttgaaaacccaatcccattaggtgaattaaaggctattcgtggtcttgatggtattaaggctgctagtgttccattaaagactaaggatggtaaggatgttaatgttcgtgctgccgtagttagtggtggagctaacattcaaaagttcttagaaaagcttaagaagaaggaacttgaattcgatttcgttgaaatgatgatgtgcccaggtggttgtattaacggtggtggtcaaccaaaatctgctgatccaaaggttgttgccaagaagatggaacgtatgtacactatggatgatcaagcttctcttcgtttatctcacgaaaacccagaaattactcaaatttacaaggaattcttaaaggaaccaaatggtcacctttctcacgaattattacacactcactacaatgatcgttcaaaggctattcaagatatgagccttcatcaaaagtaa

SEQ ID NO: 120 - DNA, 1170 bp, Neocallimastix frontalis
actgaaagaaatgaagttattgaagttttaagacaattagatagtaagagaaagattcttgtttgttctactgctccagctattagagttgctcttgccgaagaattcaatgctgatccagatttcaacttcactggtaagatggttgctggtttacgtaagcttggtttcgattacattttcgatactaatttctccgctgatcttactattatggaagaaggtactgaattaattaaccgtttaaataatggtggtaagttcccaatgttcacttcatgttgtccaggttggattaacatggttgaaaagagttatccagaattacgtgaaaacctttctacctgtaagtctccacaacaaatgataggtgctctcattaagtcttactttgctaagaagttaggtgtaagtaccgaagatattattcatgttagtgtaatgccatgtactgctaagaagggtgaagctaagcgtccagaatttgttcaaaagggtaaggatggtaagaactacccagatattgattacgtccttactactcgtgaattattaactttaatgaaacttaagaaggttaacccagctgaacttgctgatgataaactcgatagtccattaggtattagttcttctgctggtaacttattcggtgttactggtggtgttatggaagccgctgttcgtactgctcaaattattactggtgttgaaaacccaattccattaggtgaattaaaggctgttcgtggtcttgaaggtattaaggctgctactgttccattaaagactaaggaaggtaaggatattaatgttcgtgctgctgttgttagtggtggagctaatattcaaaagttcttagaaaagattaagaataaggaagttgaatttgatttcgttgaaatgatgatgtgtccaggtggttgtattaacggtggtggtcaaccaaagtcagctgatccaaagattgttactaagaagatgcaacgtatgtacactatggatgaacaagctactcttcgtttatctcatgaaaatgaagaagttaagcaaatttacaaggaattccttattgaaccaaatggtcatctttctcatgaattattacacactcattacaatgatcgttcaaaggctattcaagatatgagtcttcatgaaaagaaataa

SEQ ID NO: 121 - DNA, 1377 bp, Desulfovibrio desulfuricans
atgaatggacagcagaatgtgatacgcattgacagcgatatatgcacgggctgcggccggtgcaaagatgtctgccccgtgggggcggtggaaggggtgcaggggacgccgcacagtatcagagaggatgtctgcgtattgtgcgggcagtgcgtgcagcagtgcagtgcttttgcctctttttacgaacagcaccctgcctgcattgccgaaaagaagcgggaaagaggcctttttgtttcggaggcagcaccgctttttgccgcatggcacacgggggatgcaccgcgggtggccggtcgtctggcagaaggctgccacagcatggttcagtgtgcgccagccgtgcgtgctgccatcggcgaagagttcggtatgcctgcgggggcgctgacccccggaaggctggccgcagcattgcgcaggctgggattcgacagggtttacgacaccaattttgcagccgacctgaccataatggaagagggcagtgagctgctgcagcgtatggaaggcgccggaccgctgcccatgttcacgtcgtgttgccccgcatgggtccgttatgccgaacagcagttccccgacctgctggaacatctttcatcctgcaagtctccgcagcagatggccggagccgttttcaagtcgtacggggcgcagctggacggtgtggacccgcggcaggttttcagcgtggcggtgatgccctgtacctgcaaaaaggcagaagcgcagagacccgggatggagcatgacggggtgcgtgatgtggatgcggtgctgaccaccggcgagcttgcggccatgctgcgtcaggcgcacatagattttgccgctttgcccgacgagccgtttgaccggcctctgggcagctactcaggtgccgggaacattttcggactgaccggcggagtgatggaagccgcgctgcgtactgcctatgaactggtgaccggagaacccgtgccctgcacggaactggtgtatgtgcggggcggcgaaggaatccggcacgcaaccctgaccatggacggccgcaccttccgcgtggctgtggtggccggattgcagcatgtgcgtccgctgctggaagccgtgcgcgcgggtacctgtgatgtgaattttgtggaggtgatgtgctgcccgcagggctgcataagcggcgggggccagcccaaagtgctgctgccttttcagcgggatgaggtgtatgccgcgcgcaaggcggcgctgtaccgccacgatgccgagcttgcctgccgcaaatcgcatgaaaatccgcaggtgcaggcgttgtaccgtgaatttctgggcgaacctctgagccatgtttcgcacaatctgctgcatactgtttacggccagacgcgttag

SEQ ID NO: 122 - DNA, 1665 bp, Desulfitobacterium hafniense
atgatgcaattaaagcacccgtttcagtctggatttcaacagcaatcatgcaaaagacatactaaaaaggtggtagtagacatggaaagtaaggcaggaaagggaagcaatctgtccagacgctccttccttaaatttgccgggggggcaggtatcgccggtgcctccctgagcttaacaggttgcggccaacccctcaccccggccagtgcggtgggcggtgagggctggatgccgacccaatacaatgaaccggggggctggcccaccaatgtgcgcggccgtgtacccattgatccggaaaaccctgccctgaggagagatgaccaaaagtgcattctctgcgggcaatgcatcgaagtatgtaaaaccatccaatccgtgtatgggaactacgaactgccccttaaaaacgaaattccctgcatcaattgcgggcagtgtatccactggtgcccctccggagcaatctccgagcgggaggatattgatcaagtagccaaggctctcgccgatcccaagatcactgtggtggtgcagactgcgccggccactcgtattggcttgggggaagaattcgggctgcctgtgggaaccaatgtccagggcaaacaagtcgccgctttgcgaaaattaggctttgacgtgatttttgatacgaacttcgcggcggatctgaccattatggaagaaggcacagaactggttaagcgtattacaggagaattgcaccatcctcttccccagttcacctcctgctgcccggggtgggtcaaatttgtcgagtattattaccctgaactccttcccaatttatcatcagccaagtctccccagcagatggccggagctttggttaagacttattttgcggaaaagaaccatgtcgagccccagaagatcttctcggtggccatcatgccttgcacagccaagaaatttgaatgtcagcgcccggaaatgatttccgctcaaacctattggcaggatgagcaggtttcccctgatgtggatgtggtccttaccaccagagagctggcccgcatgatcaagagagcggggatcgatctgccctctcttcccgatgaagagtatgatcagctgatgggtgtggcaaccggagccggggcgatcttcgggaccaccggcggcgttatggaagcggccgtccgctccgcctactatctggtcacaggagaacagccccctgccgcgctttggcaactaactccggtacggggcatggaaggggtcaaagaagcggcagtttctattcccggtgccggtgagatcaggattgcagtcatttccggcctggataatgccagagccatcatggaacaagtgaaagcagggaactctccctggaccttcatcgaagtcatggcctgccccggcggctgccaatacggcggcggacagccccggtcatcggctcctccttcagacggggtgcgcaacacccgggccgcatccttatataagatcgatgcccaggcaaagctgcgcaacagtcatgataatccgcagattaagcaagtctatgccgagttcttaacttcgcccttgagtgagaaagcagaagaactattgcatacccattatatttccagggctgaagagtttgacgctaagaaaccccaaagccatgagtatgaagtttag

SEQ ID NO: 123 - DNA, 1737 bp, Eubacterium acidaminophilum
atggtgaatattactatagatggcagacaggtgacagttccggctaactctactgtgcttgatgctgccagagatatgggcataaatataccaactctttgttatcttaaagacatcaataagactggcgcttgcagaatgtgtcttgttgaagttgaaggaataaggaatcttcagactgcttgtactttcccggtaagagacggtcttgtagtaaagacgaatacaaagagagtaagagacgcaagaagagacaaccttcagctaatactttcaaaccaccacagagattgcctgtcatgctttagaaacggaagctgcgagcttcaggctctatgcgacgacatgggcctttcagagcttgatttcgaggcgccaaaagagcttaagcctgtagacatgctttcccactcgatagtaagagacccaaacaaatgcatactttgcggaagatgcgtagctgtttgtaacaaggttcaggaagtaggcatacttgcatttacaaacaggggtgttgaaactgaggttgctcctgcatttgctacaagcatggcagatgctccatgcatatactgtggacagtgcgtgaatgtatgtcctgttgcagctcttagagaaaaaacagacatagaaaaagtttgggaagtacttgaagatgaaactaagcatgttgtagttcaagttgcacctgcggttagggcggcacttggagagatgttcggcaatccgataggaacaagggttacaggaaaaatgttcactgcgcttaaaatgcttggattccagaaggtattcgacaccaactttgcagccgaccttacaataatggaagaaggaacagagcttcttggaagaatcaaaaacggaggaactcttccgatgataacttcttgctcgcctggctggataagatacgttgagcacttctatccagaattgcttgaccacgtatcttcatgcaagtcgccgcagcagatgatgggagcagtgcttaagtcttactatgcagaaaagaacaacatagcgcctgagaacatgatagttgtttcagtaatgccatgtatagccaagaagactgagtcggccaaggaagaaatgaaaaacgttcacggaacaagggacgttgacatagttcttactacaagagagcttggcaagatgataaaagaggcaaggattgaattcaacgatcttcaagacagcaatcctgacgagttcttcggagactacactggagccgctgtaatattcggagcgacaggcggagttatggaagctgctataagaacggttgctgacatagtaagcggacaagagcttgaagacatcgaatatactgcggtaaggggacttgaaggcatcaaggaagctgcagttaaaataggcgatcttgaggttaaggttgcggttgcacacggaactgcaaatgccggaaagcttatggatttagttagagatggcaaagctgactaccactttattgagataatgggatgctcaggcggctgtgtaacaggcggaggccagccacacgttgactcaagaaccaaggaaaaggtaaatgtgaagcttgaaagagcaaaggctctatacacagaagacaagcttagggacaagaggaagtctcaccacaacgagtctgttaagaggctttatgaagagtaccttggaaagcctaacggccacaaggctcacgagcttcttcacactcactacaaaaagagagaactattctaa

SEQ ID NO: 124 - DNA, 1860 bp, Rhodopseudomonas palustris
atgtgcacgcccgatcaagccagcctgtctgcccgcgatcccgccgaggcaacgatcacgctctcgatcaacggcgtcgcctgcgccggcttcgccaacgagaccatcctgtcctgtgcgcggcgctacgacgtctacatcccgacgctgtgcgaactggaagacatcgatcacacccccggcgcctgccgggtctgcctggtcgagatcctgcaggccggtaaggacaccccgcagatcgtcaccgcctgcaacaccccggtgcgcgacggcatggaggtgcagacccgctcgaagaaggcgcgggacatgcagcgtcttcaggtcgaactgctgatggccgatcatctgcaggattgcgccacctgcatccgccacggcagctgcgagctgcaggatctggcgcagttcgtcgggttgcagcagaaccggttcttcgaccgggagcggaccgaggcgcggccggtcgaccacagctcgccgtcgatggtgcgcgacatgcggcgctgcgtccgctgccagcgctgcgtcgcgatctgccgctatcaccagaagatcgatgcgctggcgatcgaaggcagcgggctggagcggatggtggcgctgcgcgacgccgacggctatccgaattcggtgtgcgtgtcctgcggccagtgcgtgctggtgtgcccgaccggtgcgctcggcgagcgcgatgagaccgatcgggcgctcgactacatctgcgatccgaacgtcgtcaccgtggtgcagttcgcccccgcggtgcgggtcgcgttcggcgaagaattcggtctgccggcaggcaccaatgtcgagggccagatcatcgccgcctgccgcaagctcggcgtcgacgtggtgctcgacactaacttcgctgccgacgtagtgatcatggaggagggtgccgaactgctggcgcggctgaagcaggggcggcgcccgaccttcacctcgtgctgcccggcctggatcaacttcgccgagatccactatccggacgtgctgccgctgttgtcctcgaccaagtcgccgcagcaggtactgtcgaccatcgccaagagctatctgccggcgcagcttggcgttccggcggagcgtatccgggtgatttcgatcatgccgtgcatcgccaagaaggacgaggctgtgcggccgcagatggtccatgacgggcagcccgaaaccgacctggtgctgaccacgcgcgaattcgcccggctgctgcggcgcgagggcatcgatctgaaggatctgccgtcgtcgcagttcgaccgcccgttcctcagcgcctattccggtgccggcgccatcttcggcaccaccggcggcgtgatggaagcggcggtgcggaccatctacgcgctggtcaatggccgcgaactggaacggatcgagctgacgcagctgcgcggcttcgaagggctgcgcgaggcaactgtcgatctcggcgccccggtcggcgaggtcaaggtcgcgatggttcacggcctcggcgacacccgcaagttggtggagtcggtgctgagcggcgaggccaactacgacttcatcgaggtgatggcctgtccgggcggctgcgtcgacggtggcgggtcgctgcgctcaaagaaggcgtatctgccgctggcgctgaagcgccgcgagaccatctacaatgtcgaccgcgccgccaaagtccggcagtcgcacaacaatccgcaggtgcaggcgctgtaccgcgaactgctgcaggcgcccaattcggaaatcgcgcatcggctgctgcacacccactacgcgtcgcgcaagcgcgagctgcagcacaccgtgaaggagatatgggacgatctcaccatgagcacgatcctgtactga

SEQ ID NO: 125 - DNA, 1935 bp, Clostridium thermocellum
atggatagtttcctgatgaaaggttatatcaaagaggcaaacatagattacagctgcagccgtggttccatggaagacttaccaaagtgggaattccgcgaaataccgaaagttcctcgtgcggtaatgccttccctttctctggaagagcgtaaaaacaattttaacgaggttgaattgggtctttctgaagaagttgcaagaaaagaagcacgccgctgtttaaaatgcggatgcagcgcccgtttcacctgcgatttgagaaaagaagcaagcaatcatggcattgtatatgaagaaccaattcacgaccgcccatatatcccgaaagttgatgaccatcctttcatcgtaagggatcacaacaagtgtatctcctgcggccgttgtattgccgcatgtgctgaaattgaaggcccgggcgttctcaccttctatatgaaaaacggtcgccagcttgtaggtacaaaaagcggtcttcctctcagggacacagactgcgtaagctgcggtcagtgtgttactgcatgtccttgcgccgctctcgattatcgccgtgagagaggaaaggtggtaagggcaatcaacgatcccaaaaagactgttgtcggatttgtcgcaccggcagttcgcagtcttatatccaacaccttcggtgtctcatatgaggaagcatctccgtttatggcaggcctgcttaaaaagcttggctttgacaaggtgtttgactttacctttgccgcagacctgactattgtggaagaaaccacggagttcctctcaaggatacaaaacaagggtgtaatgcctcaatttacatcctgttgtccgggatggatcaatttcgttgaaaagagataccccgaaataatccctcacctgtccacctgcaaatcaccgcagatgatgatgggtgcaacagttaaaaatcactatgcaaaacttatgggaataaataaagaggatcttttcgtggtatccatagttccatgtcttgcgaagaaatatgaagctgcccgtccggagtttatccacgacggcatccgcgatgtggacgcagttcttacaactacggaaatgcttgaaatgatggaacttgccgatatcaaaccttcggaagtggttcctcaggaatttgacgagccttacaaacaggtttccggtgccggaatactgtttggtgcttccggcggtgtggctgaagccgcccttcgtatggccgttgagaaacttacaggaaaagtgctcaccgaccaccttgaatttgaagaaattcgcggctttgaaggtgtgaaagaatccaccatagacgtaaacggcacaaaagtgcgcgtggcagttgtcagcggccttaagaatgctgaacctatcattgaaaaaatactcaacggggttgacgtgggatacgacctcatagaagtaatggcatgccccggtggatgtatctgcggagccggacatccggtccccgaaaaaatagattctcttgaaaagcgccagcaagttcttgtaaatatagacaaagtttcgaaatacagaaaatcccaggagaatccggatatcttaaggctgtacaatgaattttacggtgaaccgaattctcctctggctcacgaacttttgcacacacattatactccaaagcacggtgacagtacctgcagccctgaacgtaaaaaaggaacggcagcatttgatgtgcaagagtttacaatctgcatgtgcgaatcctgcatggagaagggcgctgaaaatctctacaacgatttaagctcaaaaattagactgttcaaaatggatccgtttgtgcaaataaagagaattcgattaaaagaaacccatccgggcaaaggcgtgtatatcgcccttaacggaaaacaaattgaggagcctatgctcagcggtaatatcccggacgaatcagaatcagaataa

SEQ ID NO: 126 - DNA, 1719 bp, Clostridium perfringens; identical to SEQ ID NO: 98

SEQ ID NO: 127 - DNA, 1752 bp, Clostridium thermocellum
gtgcatgtattgaaacttgtgcattccacgcaatattggagggctgaagagatggataacagagagtatatgttgatagacggaattcctgttgagataaacggtgaaaaaaaccttcttgagcttattcgaaaagcgggcatcaagcttccgacattttgttaccattccgaattgtcggtttacggtgcctgccgtatgtgcatggttgaaaatgaatggggcggattggatgctgcatgttccaccccgcccagagcgggcatgagtataaaaacaaacactgaaagacttcaaaaataccggaaaatgattttggagcttttgcttgccaatcactgtcgggattgtacaacctgcaataacaacggaaaatgcaaactgcaggatcttgcgatgaggtacaatataagtcatattcgattcccaaacactgcttcaaatccggatgtggacgattcttccctttgcataacaagggaccggagcaaatgcatactctgcggagactgtgttcgtgtatgcaatgaagtacagaatgtgggtgctattgattttgcctacagaggctctaaaatgacaatcagtacggtatttgacaaacctatctttgaatcaaattgtgtgggctgcggacaatgtgccctggcatgtccgacaggagcaattgttgtaaaagatgatacacagaaagtatggaaggaaatctatgataaaaatacccgggtatcggtgcagatagctcctgctgtccgtgttgctttaggaaaagaacttggcttaaatgacggagaaaatgccataggaaaaattgtggcggcactgcggcgcatgggatttgatgatatatttgacacgtcaaccggggcggatttgacggttctggaagaatcggcagaactgctaaggcgtattagagaaggaaaaaatgacatgcctctttttacgtcatgctgtcctgcatgggtaaactactgcgaaaagttctatcccgagcttttgccccatgtttccacatgccgttcaccgatgcagatgtttgcctccataataaaagaggaatattcaacttccagcaaacggttggtgcatgttgcagttatgccctgcacggcaaagaaatttgaagcggcccgcaaagagtttaaagtcaatggagttccaaatgttgattatgttctgacaacccaggagcttgttcgaatgatcaaagaatcggggatagtattctctgaactggagcctgaagcaattgacatgccctttggaacgtatacaggagccggtgtgatatttggggtttccgggggtgtcactgaagcggttttaagaagagtggtttcggacaaatctccgacatctttcagatcacttgcctataccggtgttcggggtatgaacggagtaaaagaagcttcggtgatgtacggtgacagaaagcttaaagttgcagtggtcagcgggcttaaaaatgccggtgatttgattgaaaggattaaagccggtgagcattatgatcttgtcgaggttatggcatgtccgggaggttgtataaacggaggaggacagccctttgttcaaagtgaggaaagagaaaagaggggcaaggggttgtacagtgcggataaactctgcaatatcaaatcttctgaagaaaatcctcttatgatgacactttataaaggcattttaaagggcagggttcatgaacttcttcatgttgattatgcttcaaaaaaggaggcaaagtag

SEQ ID NO: 128 - DNA, 1320 bp, Desulfovibrio desulfuricans
atggctggatgcaaagcacagcacccgcccgcagcctatctggcagggttggaagtacctgccgcaggctccgaggtaaccatggaaggtgttcgttataaaatgaacgcccccaaggatgtagaccccgcaaccatccggtttgtggaggtcgaccacgacaagtgcatggcgtgcggcgagtgtgagtatcactgtcccacaggcgtcatgcaggaagtgaccgaagacggctatcgcggtgtcgtggaccccgtggcgtgcgtcaactgcgggcagtgtcttgcaaactgtcccttcggcgccatccatgaagaggtgtcgtttgtaggcgaattgtacgaaaaactcaaggatcctgacacggttgtcgtatccatgcctgctcccgccgtgcgctatgcgctgggtgaatgcttcgggctgcctacgggtacgtatgtgggcgggcagatgcatgccgccctgcgccgtctgggctttaatctggtgtgggatacggaatggacggctgacgtgaccatcatggaagagggcaccgaactgctggaacgcgtgaagcacggcaatatgccgctgccgcagttcacttcctgctgccccgggtggatcaagtttgccgaaacgttctaccccgatctggaaaagcacctttccacctgtaaatcccccattgccatgatcggcccgcttgccaaaacgtatggtgcgcaggaggccggggtacccgccaaaaaaatgtacaccgtgtccatcatgccctgcatagccaaaaagtttgaaggtatgcggcctgaaatgaatgccagcgggtacagagacatcgacgccaccatcaccacgcgtgagctggcatggatgattaaaaaagcgggcatcgacttcacttcgctgccttccgaagaaccggatcccgcgctgggcatgtccactggtgctgccaccattttctgcaccagcggcggtgtaatggaagctgccctgcgtctggcgtatgaagcgctgtccggcggcacccttgccgaccccgacatcaaggtggtgcgcacgcatgagggtataaatacggcagaagtgcccgtacccaacttcggcaccgtgaaagtggccgtggcaagcggtctggacaatgccgccaagctgtgcgaggaagtgcgcgcaggcaaatcgccttaccacttcatcgaggtgatgacgtgtcccggcggctgcgtaaacggcggcgggcaaccgcttgaaccgggcatgctgcagtcttcccttttcaagagcactatcaccaagatcaaccgtcggtttaccagacggtctgtggcatag

SEQ ID NO: 129 - DNA, 1137 bp, Desulfovibrio desulfuricans
atgaacttggttgaaatggaaaagattcagtatgtggatcagtcgcctgacccgcgagcgaatccggatgaactttttttcatccagattgatccggaaaaatgtatcggctgcgatacctgtcaggagtattgcccgacgggcgccatatttggcgataccgggagtgcgcatagtattcctcatgaagaaatctgcatcaattgcgggcagtgtcttactcattgccctgtcggagccatttacgaggtgcagtcctgggttcgggagctgagtgaaaaaatcaaagatccggagatcaaggtaatcgccatgccggctcctgctgtccggtatgggcttggagaatgtttcggcatgccggtgggcacggtaaccacgggaaagatgctgacagctttgcagatgctgggctttgaccacgtatgggacaatgagttcaccgcagatgtcaccatatgggaagaaggcaccgagtttgtcaaacgccttacagggcagattgacaagccgcttcctcagtttacctcttgctgccccggctggcacaaatatgtggaaagcttttatcctgagttgttcccgcatctttcaagctgcaaatctcccatcgggatgatgggcgcactggccaaaacgtatggaccggatgtgatgaaatatgatcggtccaaggtttatacggtttccattatgccctgtaccgctaaaaagtatgagggcatgcgcgcggacctgtggtccagcggctacaaagacattgacgcaaccatagacacccgcgaactggcctacatgataaaaaaggcaggcattgatttcgccgctctgccggacggcaaacgggacacgttgatgggtgattccaccggtggggccacgattttcggtgtatccggcggtgttatggaagcggctttgcgttatgcctacgaggctgtgaccggcaaaaaaccgtcgagctgggattttacgatggttcgcggcctgaacggtatcaaagaaggtactgtcaccattggcgatgcaaagataaacgtggcggtggttcacggagcaaagcgttttgcggaagtatgcgaggtgattaagacagggaaaagcccgtgcatttcatcgagtttatgcctgccccgg

SEQ ID NO: 130 - DNA, 1266 bp, Desulfovibrio desulfuricans
atgaacttggttgaaatggaaaagattcagtatgtggatcagtcgcctgacccgcgagcgaatccggatgaactttttttcatccagattgatccggaaaaatgtatcggctgcgatacctgtcaggagtattgcccgacgggcgccatatttggcgataccgggagtgcgcatagtattcctcatgaagaaatctgcatcaattgcgggcagtgtcttactcattgccctgtcggagccatttacgaggtgcagtcctgggttcgggagctgagtgaaaaaatcaaagatccggagatcaaggtaatcgccatgccggctcctgctgtccggtatgggcttggagaatgtttcggcatgccggtgggcacggtaaccacgggaaagatgctgacagctttgcagatgctgggctttgaccacgtatgggacaatgagttcaccgcagatgtcaccatatgggaagaaggcaccgagtttgtcaaacgccttacagggcagattgacaagccgcttcctcagtttacctcttgctgccccggctggcacaaatatgtggaaagcttttatcctgagttgttcccgcatctttcaagctgcaaatctcccatcgggatgatgggcgcactggccaaaacgtatggaccggatgtgatgaaatatgatcggtccaaggtttatacggtttccattatgccctgtaccgctaaaaagtatgagggcatgcgcgcggacctgtggtccagcggctacaaagacattgacgcaaccatagacacccgcgaactggcctacatgataaaaaaggcaggcattgatttcgccgctctgccggacggcaaacgggacacgttgatgggtgattccaccggtggggccacgattttcggtgtatccggcggtgttatggaagcggctttgcgttatgcctacgaggctgtgaccggcaaaaaaccgtcgagctgggattttacgatggttcgcggcctgaacggtatcaaagaaggtactgtcaccattggcgatgcaaagataaacgtggcggtggttcacggagcaaagcgttttgcggaagtatgcgaggtgattaagacagggaaaagcccgtggcatttcatcgagtttatggcctgccccggaggatgtgtctgcggtggcggtcagcctgtgatgcccggagtactggaagctatggaccgcaaagtttccagaacctttgccggactcaaagagcgtctgaacagaatgtcgtccagcaaggcatag

SEQ ID NO: 131 - DNA, 1107 bp, Trichomonas vaginalis
tgcgatggcaagtggctctccccagcttgcgttacaacagtttgggatggtctcaagatcgacacaaagtccaagaacgttcgcgactccgttgagaacaacctcaaggaactcctcgactgccacgatgaaacatgctcagcttgcattgctaaccacagatgccagttccgtgacatgaacgtcgcctactccgtcaaggccgagacaaaggagatctgctccgaggaaggcattgatgaatccacaaacgctatccgccttgatacatccaagtgcgtcctttgtggccgttgcatccgtgcttgcgaagaagtcgccggcacatccgccatcatcttcggcaaccgtgccaagaagatgagaatccagccaacattcggtgtcacacttcaggaaacatcctgcatcaagtgcggccaatgcacactttactgcccagtcggtgccatcacagagaagtcccaggttaaggaggccctcgacatccttgctaacaagggtaagaagatcacagttgtccaggttgctccagccgttcgtgttgccctctctgaagctttcggctacaaggaaggtacagtcacaacaggcaagatggtctctgctctcaaggccctcggcttcgacctcgtttacgatacaaactacggtgcagatcttacaatctgtgaagaagctggtgaacttgtcaaccgccttagagatccaaacgccaagttcccaatgttcacatcctgctgccctgcttgggttaactacgtcgagcagtccgctccagacttcattccaaacctttcatcctgccgctcaccacaaggcatgctttctgctttgatcaagaactaccttccaaagcttcttgacgtcaagcaggaggatgtccttaacttctccatcatgccatgcacagccaagaaggatgaagttgagcgcccagaactccgcacaaagtctggccccaaggaaacagacatggttctcacagttagagaacttgtcgagatgatcaagctctccaacatcgacttcaacaaccttccagatacacagttcgataacatcttcggcttcggctctggtgctggccagatcttcgctgccaca

SEQ ID NO: 132 - DNA, 1107 bp, Trichomonas gallinae
tgtgacggaaagtggctttctccagcctgcgtcacaacagtttgggatggcctcagaatcgatacaaagtctaaggtcgtcagagactcagtcgagaacaacctcaaggaactccttgactgccacgatgagacatgctcatcctgcgttgctaaccacagatgccagttcagagacatgaacgtcgcctactccgttaaggctgacaccaaagaaatctgctctgaagagggcatcgatgagtcaacacacgccatcagactcgacacatccaagtgcgtcctttgcggccgttgcatccgcgcttgcgaggaagttgctggcacatccgccatcatcttcggcaaccgtgctaagcacatgagaatccagccaacattcggtggcacacttcaggagacagcatgcatcaagtgcggccaatgcacactctactgcccagtcggtgccatcacagagaagtcccaggttaaggaggcccttgacatccttgctaacaagggcaagaaggtcacagtcgtccaggtcgctccagccgtccgtgttgctctctccgaggctttcggctacaaggagggtacagtcacaacaggcaagatggtttccgccctcaaggccctcggcttcgacttagtctacgacacaaactatggtgctgaccttacaatctgcgaagaggctggcgaactcgtcaaccgccttaaggatccaaaggctgtcttcccaatgttcacatcctgctgcccagcttgggttaactacgttgagcagtcagccccagacttcattccaaacctttcctcctgccgctcaccacagggcatgctttcctccctcatcaagaactaccttccaaagctcctcggcatcaagcaggaagaagtcatgaacttctccatcatgccatgcacagctaagaaggacgaaatcgagcgcccagagctccagacaaagactggcctcaaggagacagacatggttctcacagttcgcgaactcgtcgagatgatcaagctctctaacatcgacttcaacaaccttccagatacaccattcgacaacatcttcggcttcggctctggtgctggccagatcttcgccgccaca

SEQ ID NO: 133 - DNA, 1368 bp, Nyctotherus ovalis
atgatttcaaggttaatagccaagaaggcccctcttttcttgagaaccttcgctacttccgagatgattagcctcaagatcgatggcaagatcatctctgttcctaaaggaataatgttggctgacgcaataaagaaggccggagcaaatgttccaacaatgtgctatcacccagatctgccaacttcaggaggcatttgccgagtgtgtttagtggaaagtgctaagtccccaggttaccctatcatcagctgcagaactccagttgaagaaggcatggaaatcgttactcaaggctctaaaatgaaggagtatcgccaagcaaatcttgccttgatgttgtctcgccatccaaacgcttgcctctcatgcacttcgaataccaattgcaagacccaagagctatcagccaatatgaatatcgggcagtgtgggttcgccaatgcaactccaccaaagaacgatgatagctatgacatgaccacagccattgaaagagataatgataaatgtattaattgcgatatctgtgttcatacttgctctcttcaaggtcttaatgcccttggtttctacaatgaagaaggtcatgccgttaaaagcatgggcacccttgatgtttctgagtgtattcaatgcggtcaatgcatcaaccgctgtcctactggagccatcacggagaagtcagaaataaggccagtgctggacgccatcaatatccaacaaagacttgttttccaaatggctccttctatccgtgttgccgtagctgaagaatttggtatcaaaccaggcgaaaaaatcttaaagaacgaaatagcaacagcattgcgtaagttaggatctaatgtatttgtgttggatacgaacttttcggctgacttgacaatcattgaagaaggccacgagttgattgaaaggctatatagaaacgttacgggaaagaaattgctgggtggcgatcatatgccaattgatcttccaatgctgacaagttgctgtcctggttggatcatgttcattgaaaagaactaccccgatttgcttaacaatctatcaacctgcaagagtccgcaaggaatgctaggagctttaattaaaggttactgggcgaaaaatattaagaagatggatcctaaagatattgtgagtgtttctataatgccttgcacagcaaagaaggccgaaaaggaaagaccacaattgagaggtgatgaaggatataaggacgtggattacatcctgaccacacgcgaattggcaaagatgttaaagcaatcaaatattgatcttgctaaaatggagccaacaccttttgataaggttatgagtgaaggaacaggtgctgccgttatctttggtgttact

SEQ ID NO: 134 - DNA, 1107 bp, Trichomonas vaginalis
tgcgacggcaagtggctcgcaccagcctgtgttacaacagtttgggatggcctcaagattgatacaaagtcaaagatggttaaggagtccgtcgagaacaatcttaaggaacttctcgattgccatgatgaaacatgctcatcttgcgttgctaaccaccgttgccagttccgtgacatgaatgttgcctattccatcaaggcagaaacaaaggaagaatgctccgaggaaggcatcgatgaatcaacaaactcaatccgcctcgatacatccaagtgcgttctttgcggcagatgtatccgtgcttgcgaagaagttgctggccaatcagccattatctttggtaaccgtgctaagcacatgagaatccagccaacattcggccaaacactccaagatacttcttgcatcaaatgtggtcagtgtacattatactgcccagtcggtgctatcacagagaaatcccaagttaagcaggcccttgatatcctctccaacaaaggaaagaagatttccgttattcaggttgctccagctgtccgtgttgctctttctgaagcatttggatacaaggaaggctccgttacaacaggaaaaatggtttccgctctcaaggctcttggtttcgactatgtttatgatacaaattattccgccgatcttacaatcgttgaagaagccggtgaactcgttcagcgccttaaaaatccaaacgctgtcttcccaatgttcacatcttgctgccctgcttgggttaactatgttgaacaatctgctccagatttcattccaaacttatcatcctgccgctcaccacaaggcatgttatcatctcttgttaagaactaccttccaaaggtcctcaacattccagttgaagatgttcttaacttctcaatcatgccatgcacagctaagaaggatgaaatcgaacgtccagaactccgcacaaaggacggacacaaggaaacagacatggttctcacagtccgtgaacttgtcgagatgatcaagctctctggaattgatttcaacaatctcccagatacaccattcgacagcatcttcggtttcggttctggtgctggtcagatcttcgctgcaaca

SEQ ID NO: 135 - DNA, 1395 bp, Entamoeba histolytica
cgattacatacagtcaccggacatgaccataaccatagtattcaatttgattggtctaaatgcatgggttgtggaatgtgtgctactaaatgtacttttggggtgttagtaaaacaaccaccaaaaattccaccatttgttcagcctaatagagaaaaactctctcaagaaaataccgacaagacaagagtacttattgatgagtctgaatgtactgggtgtggtcaatgttctttggtttgtaactttggttctattacaccaatagaccatcttgttgatacttttaaagctaaagaagctggaaagaagcttgttgctatgattgcaccttcaactcgtttaggtgttgctgaggctatgggaatgcctattggaagtacagctatggctcagttagttcattgtttaagacttattggatttgattatgtatttgatgttgatgctggagctgataagacaacaatggatgattatgccgaagttattgaaatgaaaaaagagggaaaaggacctgctattacttcctgttgtcctgcttggattgaacttgttgaaaaagaatatccagacttaattccaaacgtctctactgcccgttcaccaattggatgtttagctggttgtattaaaagaggatgggcaaaggatgtaggaatcgcagtagaagatctttacactgttggaataatgccttgtattgctaaaaaaacagagtctcaaagacaacaaattcatcaagactatgatgcttcatgtacttcaaatgaaattgctgcttatttcaaaaaacatcttccacctgaagaatgtaaatttacacaagaaagagaagaagcacttgctaaaactgaagatggtcaatgtgatttaccatttagacgtatttctggtggttctaatatttttggaaggactggaggagtttgtgaaactgtattgagagtaattgcacgtaatgcaggagttgattggaacagttgtactgttaacaaggaagaaacttttaaacatgctgcaagtggatcaacaatgacaaatctttctgttgatattggtggaactattatcacaggtgctgtttgtcatggtggttatgctattagacatgcttgtgaacttattagaaaaggagagttaaaagttgatgttgttgaaatgatggcatgtgttggaggttgtcttggaggagcaggtcaaccaaaaattccaccagcaaagaaacttgagatggataagagaagagtaatgttagatattttagatcaacaaactgatattagagctgctaatgaaaatactgatgttcttggatggattgataaacattttgatcatcaaggtgcacatcagcatcttcacacatattttactcccagatatcaaaactaa

SEQ ID NO: 136 - DNA, 1425 bp, Giardia intestinalis
atgccccctaagcctcagcatgacgtcaccggcgtagactccaataacgccattatgatagactacgccaagtgtatcgggtgcaacatgtgcatcaaggcctgtgatgttcaagggataggcgtctataagcagaacgagaagccgaagtaccctccgatagtcaagctctctaccctcttcaacagcgactgcattggctgtgggcagtgtgcaaccatatgccctgttgacgcaattgctcccaagaacaacctggagatctataagggcgagtctgcgtcgaaaaaggtcagggtggctctcattgccccttcgacgcgcgttgcgtttggagacgtctttggcctgccaataggtacaaacacaatatactcgctgatacgcatgctcaagcagtacttaggcttcgactacgtttttgacgtgaatttcggggctgatgaaacaacggtcattgacacccaggagcttcttcacttcaaacatgaggggcgtggacccgtgttcacgagctgctgcccggcatgggtcaatctttgcgagatgaaatatccagagctgcttccgcaggtgtcgactgcgaagagctgcgttgcaatggttgccacgttggtcaagagacgctgggtccaggagcatctcattcccaagggtatcgttgatagtgttgacgacgtctatgtcgccgacatcatgccttgcactgcaaagaaggatgaatcaatgcgcccccagctcaatcgagacgttgacatatgtttgacggtgcgcgaagtggcggaacatctgtatttccttcatggtgctcgtctcactctagaggaggtcgaagcagatgcactcgtcctaagacctggccgctccactcagaagaagtgggactttgatgcgccgttcaataccgtcagtggcgggtcgcatatatttggaaagaccggcggtgttgccgagacttgcctgcgctttatatcttatatgaagaagtctccaatagaaaacgtcaaggaagagctactaaaggagttcaagactccgggccaattggtgcaaacagtgaaactggtaagctgcgaaatagctggagaaacataccgtgcacttatcgctcatggcggatctgctatcaacgcagcagcaaggatggtgctcaacaaggaggtcgaatgcgacgttgtcgagcagatggcctgccctggcgggtgccagaatggtggagggatgccaaagattaaaggaaagaaagaagcggtcttgacgcgtgcgtctacgcttgatatacttgatggtaaggagcgctttgcatcagcaggagaaaataagaccctctggggctttaacggatgtcttacagagcatgaggctcacgaacttcttcatacgcactaccagcaccgccctgtagaatcgttacttcctcagtga

SEQ ID NO: 137 - DNA, 2535 bp, Desulfitobacterium hafniense
atggtgaaaattatttcaatcacaaataatgcaaagagacagggaaagggcacatcaagaaaggagaagcaagcgatgaaagaagtaacgaagcagcaacgaatcagggtaactgtcaatggacgacagatggaagtctatggtgatctgacgattcttcaggctttgcttcaggaggatatccatatcccccatttatgttacgatatccgactggagcgttctaacggcaactgcgggctatgtgtggtggagttgggagaaggcagcgaacaacaggatgtgaaagcctgccatactccgattcaggaaggtatgatcattcataccaacagtccgaggctggagcattaccgcaaaattcgtctggagcagattctggcggatcataatgccgactgtgtggcaccctgcgtcatgacctgcccggccaatatcgatatccagtcttacctgagccatgccggcaacggcaattttgagacggcgattaaggtcattaaggagcgcaacccttttcccatcgtttgcggaagagtctgccctcattcctgtgaggcccaatgccgccggaatttaatcgatgagccggtggccatcaatcatgtcaaacgatttattgccgactgggatattgcccatgaacaaccctgggcccctcgtaaaaaagcggctaccggcaaaaaaattgccgtggtgggcgccggttcctccgggctgagcgctgcttattacagcgccattcagggacatgatgtcacagtattcgaacgccatccccgggccgggggcatgatgcgttacggaattccggaatatcgcctccccaaggagactctggatcgggagatcgggctgattgccgatctgggcgtcaaaatcatgaccaacaaagccctgggcactcatatccggttggaggatctgcatcaggactttgatgcagtctatctggccattggttcctggcgggcaacacccctgcagatcgaaggagataatctggaaggagtctggctgggcatcaacttcctggagcaggtgacgaaaggagcggatattaagctgggtgagcatgtggtcgtcatcggcggcggcaatacggccatcgactgcgcccggaccgcgctgcgcaaaggggcgggctccgtcaaactggtctatcgccggacccgggaagaaatgcctgcggaatcctatgaagtggaggaagcaattcacgagggggttgaaatgtactttttaaccgccccccataagatcgtcgccgaaggcgggcgcaagctgcttcattgtatcaagatgacccttggggagccggaccgttccggccggcgccggcccattcccatcgaaggcagcgagacggcctttgaagcggatacgattatcggggccatcggtcaaagcaccaatacccagttcttatatcatgaccttcctgtcaaactgaataagtggggagatatcgaaatcaacggcaagaccatgcagacttccgagatgaatatctttgccggcggcgactgtgtcacaggtccggctacagtcattcaggccgtggcggccggacgtcatgcggcggaggccatggacagctttttgatgaaaggctatgtcaaggagcagcctatggattacagctgcagccgtgggtccctggaagatctgcctcagtgggaattcgagaagattccgcggctgaaacgggcccccatgccggccctgccaccggcggaacgacgggataatttccgggaagtggagacagggctcagtgaagagacagcaagagcggaagcccggcgctgcttaaaatgcggctgctatgagcgttatgactgtgacttgcgccaggaagccagcctgcaccatgttgagtttaagaagccggtccatgaacgtccttatatccccatcgtcgaggatcattccatcatcatccgcgaccacaataaatgcatctcctgcggccgctgcattgccgcctgcgcagaagtggaaggtcccgatattttgagcttctatatgaagcatggccgtcagctggtggggacgaagagcggactgcccctggatcagaccgactgcgtcagctgcggtcagtgtgtgaatgcctgtccttgcggcgctttggattaccgcagtgaaatcggcagggtattcagagccatcaatgatccgggcaaaacgaccgtagcgtttgtggctccggcagtgcgcagtgtggtctcttcccagtatggggtttcctatcaggaggcttcccggtttattgccggacttctgaaaaagatcggctttgataaagtttttgattttacctttgcggcggatttgaccattgtggaagaaaccacagaatttttaacccgcctgcaaagccataagccgatcccccagttcacctcctgttgtccgggctgggtcaatttcgtggagcgccgctatccggaaatcattccctatctctccagctgcaaatccccccagatgatgatgggagctacggtgaaaatcactttacggaactga

SEQ ID NO: 138 - DNA, 357 bp, Nyctotherus velox
attttattcatggaaaagaactatccagatatgctcaatcacttgtcaacctgcaaaagcccacagggaatgcttggtgcattaatcaaaggctactgggctaagaatgtgaagaaaattgatccaaaggacgttgtaagtgtatcaatcatgccttgtactgccaaaaaagaggaaaaagacagaatcaccttgaaaagtgacgaaggttacaacaacgttgactacgtgctcaccacacgagagctcgctaaaatgtttaaacaatcgaatatagatccaagtaaattgccaccgacacaatttgataacgtcatgagtgagggaactggagcggctgttatatttggcgttacg

SEQ ID NO: 139 - DNA, 1431 bp, Oryza sativa
atggcgtcgtcgtcgtcgtcggcgtcgagcaggttctcgccggcgctgcaggcgtcggatctcaacgacttcatcgccccctcgcaggactgcatcatctccctcaacaagggcccctccgcccgccgccttccgatcaaacaaaaggaaattgcagtgagcacaaatcctccagaggaagcagtcaagatttcactgaaggactgtttggcttgcagtggttgcataacatcagcagaaacagttatgcttgagaagcaaagcttgggtgacttcattactcgcatcaactctgacaaagctgtcatagtatcggtctctccacagtcaagagcatcgctagctgcattctttggtctttctcaatcacaggttttcagaaaactcactgcgctgttcaagtcgatgggcgtaaaggcagtttacgacacaagttccagtcgagatctgtccctaattgaagcatgcagtgaatttgttactcgttatcatcaaaaccagttatctagtggcaaagaagctggaaaaaatcttcccatgctttcatctgcatgcccaggttggatatgctatgcagaaaagactctcggttcatttatcttgccttacatctcagctgtgaagagcccccaacaggccattggtgctgctatcaagcatcatatggttggaaaacttggtctgaagccacatgatgtttatcatgttactgtgatgccctgttatgataaaaaactagaagctgttagggatgattttgttttctcagtggaagataaagatgttacagaggtagattccgtattaaccactggtgaagtgttagatttgatacagtccagatctgttgatttcaagaccctagaggagtctcccatggacagattattaaccaatgttgatgatgacggtcaactatatggggtttctggtggctcagggggttatgcagaaacagtctttcgacatgcggcacatgttctcttcgatagaaaaattgaaggatcagttgatttcagaatcttacgaaattcagattttcgtgaggttacactggaggtggagggcaaacctgttcttaagtttgcactttgttatggattcagaaatctgcagaacattattaggaagattaagatgggaaaatgcgaatatcactttattgaagttatggcatgtccttcaggctgcctgaatgggggaggtcaaataaaacctgccaaaggccagtctgcgaaggatcttatccaactactagaggatgtgtacatccaagatgtatcggtatccaaccccttcgagaaccctattgcgaaaagattatatgatgaatggcttgggcaacctggttcagaaaacgcaaagaagtatctacacacgaagtatcacccagtggtgaaaagcgtggcatcgcagttgcagaattggtga

SEQ ID NO: 140 - DNA, 342 bp, Psalteriomonas lanterna
attaatttagttgaaaaacattatccagaatatcttccaaatttatcatcttgtagatcacctcaaggaatgttatcttcattaataaaaaattattgggcaaaaaaaatgggaattgaaccaaaagatgttgttgttgtttcattcatgccatgtggtgcaaaaaaagatgaaattaaaagacctcaattaaaaggagaaactgattatgttcttactactagagaattaggaaaattatttaaaatgggaggtttaaatgatttaagtgttttagaacctgtaaaatatgatgatcctcttggagaatcaactggtgcagcagttatttttggtgcaact

SEQ ID NO: 141 - DNA, 357 bp, Nyctotherus ovalis
atcatgttcatggaaaagaactatcccgatatgcttaatcatttatcaacctgcaagagcccacaaggaatgctaggagctctgattaaaggttactgggcaaagaatattaagaaaatggatcctaaggatattgtaagtgtttctataatgccttgtacagcaaagaaggccgaaaaggaaagaccacaattgagaggtgatgaaggatacaaggacgtggattacatcttgactacacgtgaattggctaagatgttaaagcaatctaatattgatcttggtaaaatggagccaacacctttcgacaaagttatgagcgaaggaactggtgctgcagtcatctttggtgtcaca

SEQ ID NO: 142 - DNA, 357 bp, Nyctotherus ovalis
atcatgttcatggagaagaactatcccgacatgcttaatcatttatcaacctgcaagagtccacaaggaatgctaggagctctgattaaaggctactgggcaaagaatgttaagaaaatggatcctaaggatattgtaagtgtttctataatgccttgtacagcaaagaaggccgaaaaggaaagaccacaactgagaggtgatgaaggatacaaggacgttgattacatcttgactacacgtgaattggctaagatgttaaagcaatctaatattgatcttggtaaaatggagccaagaccttttgacaaagttatgagcgaaggaactggtgctgcagttatctttggtgtcaca

SEQ ID NO: 143 - DNA, 723 bp, Desulfitobacterium hafniense
atggcggtggagaaactgaccggggaggtcttgacagaccagctggattatcaggaagtgcgcggactccaggggatcaaagaggctgccgtggaagccaaaggcaagaaggtcaatgtagcggtgatcagcggactgcacaatgttgagccgattctggagaagatcattgaaggtatggaagtaggctatgatctgatcgaagtgatggcctgcccggggggctgtatctgcggagcgggacatccggtgccggagaagatcgatactctggagaagcggcagcaggttctcgtcaatatcgatcaaacctcccggtatcgcaaatctcaggaaaaccccgatatcctgcgcctttatgatgagtattacggagaagccaattcacccctggcccacaaattgctgcacacccattatgaagctgtgaaaagggaacctgttgccaaacatgaccgtagaatggcggattccgcttttgtaacccatgagcttactctgtgtacctgtgataaatgtacggctcaaggttcaagagaattgttcgcggcactttccgggaagatccggaagctgaaaatggactcctttgtcacggccagaaccatccgcttaaaggaaaatcatcccggccaaggagtgtatgccgccattgacgggaagctgatagaaaccccggtggagcagcttgagcagcggatctttcagcatcttattcgctga

SEQ ID NO: 144 - DNA, 261 bp, Desulfitobacterium hafniense
gtggtttccattgttccttgcatagccaaaaagtatgaggcagcccgaccggagttcaggtcagagggaatccgggatgtggatgctgtgttgacctctaccgaaatgctggaaatggcggatattaagttgatcgagcccgccgatgtggagcctcaggatttctgcgaaccctataaacgggtatccggggcggggattctctttggggcctcagggggcgtggcgaagcggccctgcggatggcggtggagaaactga

SEQ ID NO: 145 - DNA, 1434 bp, Drosophila melanogaster
atgtcgaggttgagcagagcgctgcagcttacagatatagatgattttattacgccctcacagatatgcattaagcccgtgcaaatagataaggcaaggtcaaagactggggcaaagataaagataaaaggtgacggctgctttgaggaatcagagagtggaaatctaaaacttaataaagttgatatttctctgcaagactgtcttgcgtgttctggttgcatcacttcagctgaagaagtccttatcacgcagcagagccgagaagagttgcttaaggtccttcaagagaattcaaagaataaggcctctgaagactgggataacgtgcgtacgatcgtgttcacccttgccacccagcctatactaagcttagcctatcgctatcagataggtgtggaggatgctgcccgtcatcttaatgggtattttcgcagtttgggtgccgactatgttttgtccactaaggtggcggacgatattgcgctgctcgaatgtcgtcaagaatttgtagataggtaccgcgaaaatgagaacttgaccatgcttagctcctcttgtccggggtgggtttgttacgcggagaaaacacacggaaacttcttattgccttacgtttccacgacccgatctcctcagcaaataatgggagtgcttgtgaagcaaatccttgccgataagatgaatgttcctgcgtcacgaatctaccatgtgaccgtgatgccttgctacgacaagaagcttgaggcctctcgagaggactttttcagcaaggcaaataactcacgcgacgtagactgtgtaatcacttcagttgaggtggaacagttgcttagtgaggctcagcagccgctgtcgcagtacgatctccttgatttagactggccatggtctaatgtacgcccagaattcatggtatgggctcacgagaagacgctatctggcggttacgcagaacacatatttaagtacgccgcaaaacatattttcaacgaagatttaaaaacagagttggaattcaaacagctcaaaaaccgcgactttagagaaattatacttaaacagaatggcaaaactgtcctgaaatttgcaattgctaacggtttccggaacatacaaaacttggtacaaaaactgaagcgtgaaaaggtatcaaattaccactttgttgaggtaatggcctgtccctcgggctgtataaacggaggagcacaaatacgtcccactaccggacagcacgttcgcgagcttacccggaaactggaggaattataccagaatcttccacggtccgaacccgaaaactccttaacaaaacatatttacaatgactttttagacggctttcaaagtgataaatcatatgacgtgctgcacacccgttaccatgatgtagtatctgagctcagtatatcgcttaatataaattggtaa

SEQ ID NO: 146 - DNA, 1617 bp, S.pombe
atggcaaagttgtctgtaaatgacttgaatgacttcttaagtcctggagctgtttgcataaagcctgcccaagttaaaaagcaggaatccaagaatgacattcgtatagacggggatgcttactatgaagtaactaaggatactggagagacctccgaacttgggattgctagtatttcactgaacgattgtttggcctgcagtgggtgtattacatctgcagaaacagttctggttaatcttcaatcctaccaagaagttttaaagcatttggaatctcgaaaatctcaagaaattttatatgtctcgcttagtccacaagtgagggcgaatcttgcagcttattatggtctctccttacaggaaatacaggcagtgttagaaatggtgttcattggaaaacttgggtttcatgctattttagatactaatgcttctcgtgaaattgtgttgcaacaatgcgctcaagagttttgcaattcttggttacaaagccgtgctcataaaaatcaaaaccaggttaccaattccgtcgtaaacgaacatccactcattcctcattcaacttcacaaatttcaggggttcattctaatacttcatcaaattcgggcattaacgagaatgctgttcttcccattttgtcttcatcttgtccagggtggatatgttacgttgagaaaactcactctaacttgatccctaatttgtctcgtgttcgttcacctcagcaggcgtgcggtcgtattttgaaggattgggccgtacaacaattcagtatgcaacgtaatgatgtttggcatttgagtctcatgccttgctttgacaagaagcttgaggccagtcgtgatgaattttcagagaacggtgttcgagacgtagattctgtgttgacgccaaaggaattggtagaaatgtttaaatttttacgaattgatccaattgagttaactaaaaaccccataccgtttcagcagtctacagatgcaatccctttttggtatcctcgaataacatatgaagaacagataggttctagttcaggaggttacatgggctatgttttatcatacgctgctaaaatgctttttggtattgacgatgttggaccttatgtatcaatgaataacaaaaatggcgatttgactgagtatactttacgacaccccgaaacgaatgaacagttaatatctatggcaacgtgctatggattccgaaacattcaaaatttggtacgccgcgtacatggaaattcctcggttcgaaaaggccgggttttattaaaaaaacgagtaagaagcaatgctcaaaatcctacagaagagccttcacgttatgactatgtagaagtcatggcatgtccaggtggttgtatcaatggaggcggtcagcttccattcccctctgtcgaaagaattgtctcagccagagattggatgcaacaagttgagaaactgtactatgaacccggtaccaggtctgtagatcaatccgcagtatcctatatgttagaacaatgggtcaaagatcctacgctgacacccaagtttcttcacacatcctatcgtgcagtgcaaacagataatgataatcccttattgctggccaataagtggtaa

SEQ ID NO: 147 - DNA, 357 bp, Metopus contortus
atcatttttgctgagaagaattaccctgagatggttaaccatctctccaccacgaaaagcccaatgcaaatgctcagttctctatccaaaggatactgggccaaggagggaaaaaagatagatcctaagaatgtggtgaatgtggctattatgccttgcactgctaagaaagcctggaaagagcgtcctgacatgaaggctgataatggagatccagtgactgactacgtgcttactacccgagaattaggaaccatgttgcgtcagtccaatatcaatcctgtatctcttcccaaaactccattcgataaaattatgggagagagcactggagctgccgtaattttcggagccaca

SEQ ID NO: 148 - DNA, 1389 bp, Mus musculus
atgaagtgtgagcactgcacacgaaaggaatgtagtaaaaaatcaaaaaatgatgaccaggagaatgtgtccagtgatggggcccagccaagcgatggggccagcccagccaaggagagtgaagagaagggagagttccataaattggctgatgcaaaaatatttctgagtgactgcctggcatgtgacagctgtgtgactgtggaggaaggtgtccagctttctcagcagagtgccaaggacttccttcatgtcctgaatcttaataagagatgtgatacctcaaagcacagagttctggttgtgtctgtgtgtcctcagtctctaccttattttgctgctaaattcaacctcagtgtcactgatgcatctagaaggctgtgtggcttcctcaaaagtcttggggtgcactatgtattcgacaccacaatcgctgcagatttcagcattctggagagtcagaaggagtttgtacgccggtatcaccaacacagtgaggaacagcgtgaactgcccatgttgacctctgcctgtcctggttgggtcagatatgctgagcgggtgctgggtcgccccatcatcccatatctctgtaccgccaagtccccccagcaggtcatgggctccttggtgaaggattactttgccaggcagcagaatctgtctccagagaaaatcttccatgttgtcgtggctccttgctatgataagaagctggaagctcttcgagagggactttccactactttaaatggtgctcggggcactgactgtgtgctgacatcaggtgaaattgctcagataatggagcaaagtgacctctctgtgaaagacattgctgtggatactttgtttggagacatgaaggaggtggcagtccagcgtcatgatggagtgagttcagatgggcatctggctcacgttttcagacacgcagccaaggagctgtttggcgagcacgtggaggagatcacctaccgtgcactcaggaacaaagacttccatgaggttacccttgagaagaacggggaggtcctactgcgctttgctgcagcgtacggctttcgcaacattcagaacatgatccagaagctcaagaagggcaaactcccataccactttgtggaggtgctcgcgtgtcccagaggttgcttaaatggcagaggccaagcacagacagaggacggccacacagatcgtgcactgctgcagcaaatggaagggatctactccggcatccctgtgcggcccccagagagcagtacacatgtgcaggagttgtaccaggagtggctggagggtactgaatctcccaaagtccaggaggtgctgcacaccagctaccagagcttggagccctgcacagacggcctggatatcaagtggtga

SEQ ID NO: 149 - DNA, 1374 bp, Caenorhabditis elegans
atggaagattctggattcagtggtgtcgttcgactttcaaatgtttcggattttattgctccgaatttggactgcataatcccattggaaacgagaactgtggaaaagaaaaaagaagaatcacaagtgaatatccgtaccaaaaaaccaaaagacaaagaatcttctaaaacagaagaaaagaaatccgttaaaatctcgttagctgattgtctggcatgtagtggatgtatcactagtgctgaaacagttcttgttgaagaacaatcatttggacgagtttatgaaggaattcaaaattcaaagctctcagtcgtcactgtttctccacaagccatcacttctattgctgtgaaaattggaaaatcaacaaatgaagtagcgaaaataattgcctcatttttccgaagactaggtgtcaaatacgtaattgattcatcatttgcccggaaatttgcacattctttaatatatgaagaactttcaacaactccatcaacatctcgaccacttctttcatctgcttgtccgggatttgtgtgctacgctgaaaaaagtcacggagagcttttaatccctaaaatcagtaaaattcgatcacctcaagctataagtggtgcaattatcaaaggatttctagcaaaaagagaaggtttaagcccctgtgatgtattccatgcagctgtaatgccatgttttgataagaaattagaggcatcgagagaacaatttaaagttgatggaactgatgttcgagagactgattgtgttataagtactgctgaactgttagaagaaattatcaaattggaaaacgacgaagccggagatgttgaaaatagatcagaagaagagcaatggttatcggctctttctaaaggatctgttattggtgacgatggtggtgcttctggaggatatgctgatcgaattgttcgagatttcgtgctggaaaatggaggaggaattgtaaaaacatcaaaactaaacaagaacatgttctccacgactgtagaatccgaagctggagaaattcttttaagagttgccaaggtttacgggtttcgaaatgtgcagaatctggttcgaaaaatgaagacgaaaaaggagaagacagattacgtggaaattatggcttgtccgggtggatgtgcaaatggtggaggtcagattcggtacgagacaatggatgagagagaagagaaattgattaaagtcgaggcattatatgaagatttacccagacaagatgatgaagaaacctggataaaagttcgagaggaatgggagaaacttgataaaaactaccgtaatcttctgtttacggactataggcccgttgagacgaatgttgctcaagtcttgaaatggtga

SEQ ID NO: 150 - DNA, 1389 bp, Mus musculus
atgaagtgtgagcactgcacacgaaaggaatgtagtaaaaaatcaaaaactgatgaccaggagaatgtgtccagtgatggggcccagccaagcgatggggccagcccagccaaggagagtgaagagaagggagagttccataaattggctgatgcaaaaatatttctgagtgactgcctggcatgtgacagctgtgtgactgtggaggaaggtgtccagctttctcagcagagtgccaaggacttccttcatgtcctgaatcttaataagagatgtgatacctcaaagcacagagttctggttgtgtctgtgtgtcctcagtctctaccttattttgctgctaaattcaacctcagtgtcactgatgcatctagaaggctgtgtggcttcctcaaaagtcttggggtgcactatgtattcgacaccacaatcgctgcagatttcagcattctggagagtcagaaggagtttgtacgccggtatcaccaacacagtgaggaacagcgtgaactgcccatgttgacctctgcctgtcctggttgggtcagatatgctgagcgggtgctgggtcgccccatcatcccatatctctgtaccgccaagtccccccagcaggtcatgggctccttggtgaaggattactttgccaggcagcagaatctgtctccagagaaaatcttccatgttgtcgtggctccttgctatgataagaagctggaagctcttcgagagggactttccactactttaaatggtgctcggggcactgactgtgtgctgacatcaggtgaaattgctcagataatggagcaaagtgacctctctgtgaaagacattgctgtggatactttgtttggagacatgaaggaggtggcagtccagcgtcatgatggagtgagttcagatgggcatctggctcacgttttcagacacgcagccaaggagctgtttggcgagcacgtggaggagatcacctaccgtgcactcaggaacaaagacttccatgaggttacccttgagaagaacggggaggtcctactgcgctttgctgcagcgtacggctttcgcaacattcagaacatgatccagaagctcaagaagggcaaactcccataccactttgtggaggtgctcgcgtgtcccagaggttgcttaaatggcagaggccaagcacagacagaggacggccacacagatcgtgcactgctgcagcaaatggaagggatctactccggcatccctgtgcggcccccagagagcagtacacatgtgcaggagttgtaccaggagtggctggagggtactgaatctcccaaagtccaggaggtgctgcacaccagctaccagagcttggagccctgcacagacggcctggatatcaagtggtga

SEQ ID NO: 151 - DNA, 1431 bp, Anopheles gambiae
tcgcgttttagcagcgctcttcagcttaccgatttggatgatttcattacaccgtcgcaggaatgtatcaaacctgtaaaaatcgagacgagcaaaagcaaaaccggagcaaagataacaatccaggaggatgggtcctacgtgcaagaatcctcgagcggaatccagaagctggaaaaggtggaaataacgctcgctgactgtttggcctgttcgggctgcattacttcggccgagggcgtgctgatatcgcaacaaagccaagaggagctgctgcgcgtcatgaacgcgaacaatctggccaagctgaacaatcaacgcgacgagatcaagtttgtcgtgttcactgtctcgcagcaaccgattctgtcgctggcacgaaagtacaatctcacaccggaagacacgttcgagcatatcgctggttactttaagaagcttggtgcggatatggtagtggacacaaagatagccgatgatctagcgctgatcgagtgccgcaacgagttcatcgaacggtacaacaccaaccgcaaacttctaccgatgcttgcctcctcctgtccgggatgggtgtgctatgccgagaaaacgcacggaaactttatcctcccgtacattgcgaccacccgctcgccgcagcagataatgggcgtactggtaaagcaatatttggccaagcagctgcaaactaccggcgaccggatctatcacgtcacggtaatgccctgctacgacaaaaagctggaagcatcgcgggaagacttcttcagcgaggtggaaaacagccgcgatgtggattgtgtgatcacgtccatcgaaatcgaacagatgctcaacagcctcgacctcccatcgctccagctggtagaaaggtgcgccatcgattggccctggccaacggtgcggccgtccgccttcgtctggggccacgaatcgtccggctcgggcggctacgccgagtacatcttcaagtacgcagcccgcaaactgttcaacgtccagctggacacggtcgcgttcaaaccactgcgcaacaacgatatgcgcgaagcggtgctggagcagaacggtcaggtgctgatgcgctttgccattgcgaacggattccgtaacatccagaacatggtgcagaagctaaagcggggcaaaagtacgtacgactacgtggaaatcatggcctgcccgtccggctgtctgaacggcggtgcccagatacggcccgaggaaggtagggccgcacgcgagctaacggccgagctggagtgtatgtaccgttcgctgccccagtcgaccccggagaacgattgcgtccaaaccatgtacgccacgttcttcgacagcgaaggggatctgaacaagcggcagagcttgctgcacaccagctatcatcagatcgaaaaaattaactcagccctcaacattaagtgg

SEQ ID NO: 152 - DNA, 357 bp, Neocallimastix sp.
atcatgtttgctgaaaagaacttcccagatatggtcaacaatctgtccacaactaagagcccaatgcaaatgcttagctctctaactaagggatattgggctaaggatattaagaagatcaatcctaaggatgtcgttaacgtagccataatgccatgcacagctaagaagcaagagaaggacagacctggcatgaagaccgatgaaggagacaaggttaccgactttgttttgaccactcgtgaactaggaatgatgctaagacaagccaacattgatccaacaaagctcccaggaaccaagtttgacaaggtgatgggtgaatctactggtgcagccgttatttttggtgccact

SEQ ID NO: 153 - DNA, 357 bp, Nyctotherus ovalis
atcatcttcatggaaaagaactaccccgacatgctcagccacctctccacctgcaaaagtccccaaggcatgctgggcgcactcatcaaaggctattgggcaaagaaggtgaagaaggtggatccgaaggacgtggtgagtgtttcaatcatgccctgcacggcgaagaaggcggagaaggaaaggccgcagctgaggggcgacgaaggcttcaaggacgtcgactacgtgctcaccactcgtgaacttgccaaaatgctcaagcaatccaatattgatttggggaaggtggagccgacaccgttcgacgcggtgatgagcgagggaacgggagcagcggttatattcggtgtgacg

SEQ ID NO: 154 - DNA, 1473 bp, Clostridium perfringens
atggctataaaggatgctaacaagcaatatataaagtttgacactgctgttcaagttcttaaatatgaggttttaaaaaggatagcagagaaagaatttgatggcactttagacaaagaaaagcttaatatagcaaaagaaattgtagatgatttaaaacctaatgtaagatgttgcatatataaggaaagggctatagttgaagaaagaatgaaactagctttaggtggacatgaaaatagagaaaacatgatagaggtaatagacatagcctgtgatgaatgtcctgttaatagatttatagtcactgatgcatgtagaggatgcctagctaagaaatgtagagatagttgtaattttggagctataagttttgataatagaaaatgcaaaattgattatgaaaagtgtaaagaatgtggaaaatgcaaagaagtttgtccttataatgcaatagctgaggttaaaagaccttgtatgagagcctgtattccaaaagcattatcttatgatgttgatagtaaaaaagctgtcatagatgattcaaaatgtattcaatgtggagcctgtgtagttgattgtccttttggagctataatggacaaatcttatttagtagatgttataagattacttaaagatgagaagaaagtttatgctattgtggcgccagctatatcatctcaatttaatcatagtaagattggtaaagtaattactgctataaaaaaattaggatttgaagatgtgtttgaagcagctttaggagcagatttggtggctgttcatgaatgtaatgaatttaaagaaaaaggtgaattagacttcatgacaacaagttgttgccctgcctttgtttcttatatagaaaaaaattatccagagcttaaggagtgtatatctaacactgtatctcctatggtagctatggcaaggttaataaaatctcaaaataaagatgttaaaactgtattcataggaccttgtattgcaaagaaaacagaagctaagagaaatgaggttagtggagatgttgattacgtattaacctttgaggagcttttagctttacttgactctaggaatattaaaatcgacgaatgtgaagaaagtgatactaagcatggttcattttatggaagactttttgctagaagtggaggagttactgaatcagttaaacatcttatagatagcgaagggataaaagtagattttagacctatacttggagatggaattaaggattgtgatataaaacttagattagcaaaactaaaaagagcacagggaaactttttagaaggaatggcttgtaaaggtggatgtataaatgggccaggatccttaaatcatgatattaagaatagcaaagaagttgataaatatggtgaattatcctcttctgagaagataaaagatactttagctgatattaaatttgaggatttaaatttatctaaaaatgagtaa

SEQ ID NO: 155 - DNA, 1371 bp, Homo sapiens
atgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 156 - DNA, 1227 bp, Homo sapiens
atgaagtgtgagcactgcacgcgcaaggaatgtagtaagaaaacaaaaactgatgaccaagagaatgtgtcagccgatgcaccgagtccagcccaggaaaatggagagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 157 - DNA, 1509 bp, Homo sapiens
atgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcagaaattagccaggcgtggtggtgcacacctgtgatcacagctactcgggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 158 - DNA, 1347 bp, Clostridium tetani
atgcataatgactatcgcgaaatatttaaaagactttcaaaatcctattatgatgatacttttgaaaaagaagtagaaaatattctttcatcgcatagtatggacagagaaaaacttgctaaaataatttctattttatgtggcgttaatattgaacatagtgaaaattatatatctaatttaaaaaacgctataaaaaactatacagcttcagctgaaaaagtggtaactaaattaccttgttctacccaatgtgctaaagatggagatattatttgtgaaaaatcctgtcctgtaaacgctatatttagggatcctaacgataacaatatatatataaatgatgagctttgtttagattgtggactatgtgtaaggaattgtccttctggaagtatattagataaaaaagagttcatacctcttgcagaacttctaaaaagtgagtccatagtaatcgccgcagtagctcctgctataatgggtcaatttggtgaaaatactactataaatcaattgagaacagcttttaaaaaattaggatttacagatatggttgaagtagcattttttgcagatatgcttactctaaaagaagcagtagaatatgatcattttgtgaaagatgaacaagattttatgataacctcttgttgctgtccaatgtgggtaggaatgttgaaaaaagtatataatgatttagttaagtatgtttccccatcagtttctccaatgatagcagctggcagagttctaaaattgctaaatcctaattgtaaagttgtatttgtgggaccttgtatcgctaaaaaggctgaggctagggaaaaagatttacttggagacattgattttgtattaacttttacagaattaagagacatatttgatgtctttgatatacaacctgaaaatttagaggaagacttttcatcagaatatgcttctaaaggtggaagattatatgctagaactggtggagtgtctatagctgttagtgaagctatagaaaaactattccctaataaatataagtttttaaagactatacaggctgatggtgtaaaaggatgtaaatctctattggacaaaataaagcaagaagatattagcgctaactttgtagaaggtatgggttgcgttggtggttgtgttggtggaccaaaagtcataatagatccttcagaaggtagaaatgctgtaaataatttcgcagaaaattcttctataaaagtttctgtagatagtaactgcatgaatgatatactaagcaaaataaatataaattcagtagaagactttaaagataaagataaaatctccatttttgaaagggaatttaaataa

SEQ ID NO: 159 - DNA, 1377 bp, Desulfovibrio desulfuricans
atgtatttcagaacatatgacaacaccatcaactttgaaatcatggtacgtattgcaaaagcgtttcatggtgattcctttgaagaacaggtggcccgtatcccgcttgaaatgcgccccagaaaggcgcacagctcgcgctgctgcatttaccgcgacagagccatcatccggtaccgctgcatggccatgctgggctatgccatagaagacgaaaccgacgaactgacatcgctcagccagtatgccaagggtgcgctggaacgcgactccattcagggcagcatgcttacctttatcgatgaggcctgcaacggctgtgtgcgtacccattacgaagctaccagcgcctgccgtggctgtctggcagaagcatgtgtgcagcactgccccaaggacgccgtgcgcattgtggacggcaagtccagaatcgaccccgacaagtgtgtgcagtgcggcaagtgcatgaatgtctgtccttatcacgccatagtgcagatacccataccctgcgaggaatcctgccccacgggggccataagcaaggatgaatgcggcaagcaggtcattgactatgaccggtgcattttctgcggcaagtgcatggcagcctgtccttttgccgccgtgcttgaaaaatcgcagatgatcgacgtgctgcgccgcatccgcgaaggccgcaaagttgtggccatcgtggcgcccgccatcgccggacaggtacaggcccccatgagcagactggccacggccctgcggcagctgggatttgccgatgtggccgaggtggcctccggcgcggataccacggcgcggctggaagccgatgaatttgtggagcgcatggaacacggcgcggcattcatgacgtcgtcatgctgtccggcatatacccagcttgtggacaagcacctgccggaactggctccttttgtttccgacacccgcactcccatgcactacaccgcggccatggtcaaagatcatgatccggatatggttacggtgttcatcgggccctgtgtggcaaagcgtaacgaaggcaagcatgatgagctggtcgaccatgtgcttacttttcaggaaatggtggccatgctgactgccgctggtatcagcgtcgatgcctgcgaagacggccggttcatgtttccggccatgcgcgaagggcgctcttttcctgtcagcggcggtgtgaccgccggtgtgcaggcgcatataggcacccgcgcagaagtacggccgctcagtgtggacggcctgaacaaaaaaactttccgtcagctcaagacatgggccaaaaagggttgcgaaggcaactttgtggaggtcatgggctgtcagggcggatgcgtggccggtccggccattgtcatg

SEQ ID NO: 160 - DNA, 1485 bp, Clostridium tetani
atgattgtttttgagaatcaattaaaaaaattaaagtacttagtattaaaagaagtagctaaaatgactttggaagatagattaggagaggaagatatagaaagaatatcttttgatataataaaaggtgataaagctgagtatagatgttgtgtctataaagaaagagccatagtttatgaaagggcaaaacttgcaacaggatgtttaccaaatggacaggtagcagaagaatttgtacatgttgaagatgatgatcaaataatatatgtaatagatgcagcctgtgataaatgtcctataaataaatatgttgtaacagaagcatgtagaggatgtttacaacataaatgtatggaagtatgtccagcaggttctataaacagagcagcaggaaaagcatatataaatcatgagacctgtaaagaatgtggattgtgtgagtcagcatgtccttataatgccatagcagaggttatgagaccttgtagaagggcttgtccaacaggagcgttacaaatgaatttagaagataataaggctacaataaataaagaggattgtataaactgcggatcatgtatgtcagtatgtccttttggagctatatctgataaaagctatatagtagatataacgaaagctctaaaaaataataaaaaagtttatgcaatggtagcccctgctataaccggacaatttggtaaagatgtatctgtaggtaaaatgaaaaatgctttcaaagcaatgggatttgaagatatgctagaagtagcttgtggtgcagatgcagttgcagctcatgaaagtgaagaatttatagaaagacttgaaagtggaaaaaaatatatgacaacttcttgttgtccaggatttttagggtatatagaaaagaagtttccagatcaattggagaatgtatctaatacagtatctccaatggtagctataggaagaatgataaagaaggaatatgaagattctgtagttgtatttgtaggaccttgtactgcaaaaaaagctgaaataaagagaaaagggattaaagatgcagtagattatgtgatgacttttgaagaaatagctgcacttatgggtgcctttgaaatagatccagcagagtgcgaagaagaagacataaatgatggatctaattatggaagaggttttgcacaaggtggaggagtagtttctgctatacaaaattgtataaaggataaagaaggcattaaatttaatcctttaagagttagtggaccagatcaaatcaaaagagctatgataatggccaaggtaggtaaattatccgaaaactttattgagggaatgatgtgtgaaggtggttgtataggaggaccagctactatggtatcagcagtaaaagctaaagcaccgcttatgaagtttagtaaatcatctacaataaaggacgttaaagataatgaagttttagataaatataaagacattaatatggaaagatag

SEQ ID NO: 161 - DNA, 612 bp, Arabidopsis thaliana
atggatttaataaagttgaaaggagttgactttaaagatttggaggaatctccacttgacagagtgctgacgaatgttactgaggaaggagatctttatggtgtagctgggagttctggtggttatgcagaaacaatattcagacatgcggcaaaagcactatttggacaaactattgaaggtcctctggagtttaaaactctcagaaattctgatttccgtgaagtgactcttcaattggaaggtaaaacagtgttaaaatttgcgctgtgttacggtttccagaacctccagaatattgttcggagagtgaaaacgcgcaaatgcgattatcagtatgtagagattatggcgtgccctgcaggttgcctaaatggtggtgggcagatcaagccaaagacaggacagtcccagaaagaactgatccactcactggaagctacttatatgaatgatactactttgaatacagatccataccagaatccaacggcgaagagattattcgaggagtggcttaaagagcctggttccaacgaggcgaagaagtacttgcatactcagtaccatccggtcgtgaaaagtgttacgtcgcagctcaacaactggtag

SEQ ID NO: 162 - DNA, 1476 bp, Saccharomyces cerevisiae
atgagtgctctactgtccgagtctgacctaaacgattttatcagtcccgcccttgcgtgcgtcaaacctacccaggtgagcgggggcaagaaggataacgttaacatgaacggagaatacgaggtgagcacggaaccagaccaactggagaaggtctctattaccctatcagactgcctcgcgtgttctggttgtataacgtctagtgaagaaatcttgttgagtagccaaagtcactcggttttcctgaaaaactgggggaagctttcgcagcagcaagacaaattcctcgttgtgagtgtctcgccacaatgcagactatctcttgcgcagtactacggcttaacattggaggcggccgatttgtgtttgatgaattttttccaaaagcatttccagtgcaagtatatggttggaacggagatgggcagaatcatatcgattagcaaaaccgtagagaagatcattgcgcataagaaacaaaaagaaaataccggtgcggaccgcaagcctctattatctgctgtgtgtccgggatttcttatatacacggaaaagaccaaaccgcagttggtgcctatgctgctcaatgtcaagtcgcctcagcaaattacgggctcgttgatcagagctacgttcgagagtctcgctatcgcgcgtgagtccttttaccatctgtcgctgatgccatgttttgacaagaaactagaagcgtcaaggccagaatcgcttgacgatgggattgactgtgtcattacgccacgtgaaatagtgacaatgttacaagagttgaatttagacttcaagtcgtttcttactgaggacacaagtttatatgggcggctatcaccgccgggatgggacccgcgagtccactgggcgtcgaatctgggaggcacttgtggtggctatgcctaccagtacgtaacggctgtccaacgactacacccaggaagtcagatgatagttctggagggtagaaacagcgacattgtcgagtaccgattgctgcacgatgatcgcataatagccgccgccagcgagctttccgggtttagaaacatccaaaatctggtgcgtaaactgacctcgggctccgggtcagagcgcaagaggaacatcaccgctctgcggaagagacgaacaggtccaaaggcgaactcacgcgagatggcggccgccacggccgccacggccgatccctaccactcggactacatcgaggtaaacgcgtgtccgggtgcatgcatgaacggtggtggcctactcaatggcgagcaaaacagtctcaagcggaagcagttggttcagacactgaataagcgtcacggagaggagctagcaatggtagatcctctaaccctgggacccaagctagaagaggcggcagcccgcccgctttcgctagagtacgtcttcgcgcccgtcaagcaggccgtcgaaaaggatctcgtctctgttgggagcacctggtaa

SEQ ID NO: 163 - DNA, 840 bp, Desulfitobacterium hafniense
atgaccatgggccagcttcgagccgcactgaagcatctcggtttttatggaatgattgaggtagcacttttcgccgatgtactgagcttaaaggaggccctggaatttgacaagcatgttcaaacggataaggactttgtcctcaccagctgttgctgccccatctgggtggggatggtaaagagggtctatgataccctggttccccatatctccccctcagtatctcctatggtagcttgtgggaggggaattaaacgcctgcaccccgacgccaaaacggtctttatcggtccatgtattgctaaaaaagctgaagctaaggaaccggatatccgggatgcggtagatgcagtgctaacttttcacgaactcaagcaaatctttgaagccacggatattgagccctcggagatggaggatatacccagtgagcactcttctaccagcggtagaatctatgcccgcaccggcggagtctccaaatccatctctgataccttaaaccgtatccgtccagataagccggtaaagatcaaatccattcaagctaatggcattaaagagtgcaaggccctcctcaatgatattatgaataacgagattaaagccaatttctacgaaggcatgggctgccccggaggctgcgtagggggccccaaggctatagtggatgtagatagaggtactgagttcgtaaacaaatatggtgcagaagcagacgcccttacacccgcagataatcagcatgtattggagctgcttaagcagttgggcattgatagcgtggaagagcttctgggaggagagtctgcggcaattttccaacgggatttttaa

SEQ ID NO: 164 - DNA, 1350 bp, Clostridium perfringens
atgaataaaaagtataactctttatttaaagaacttatatcttcatattattcagaagataactttgatgaaaaattaaatgatatagtaaaaaataattttaatagtaaagaagatgctattgaggttctttcatccctatgtggggttgatatagataaaaactcagataatattgcttatgacataagaaaagctataacaacacacaaaatcaaaaaaaatatagttgataaagtttctgtatgtacaaaaaactgttcaaaagaaagtaaaggtaaatgtcaaagcctttgtccctttgatgcaatactgactgatcctatagataatagtaaatatatagatccaaatctatgtcaaaattgtggtatatgtgttcaggtatgcgaaagtggtcacttcttagatagaattgaacttcttcctattattgatttaataaaaaataatgagactgtaattgccgcagtagctcctgctatagctggacaatttggtgaaaatgtctccttagatatgctaagagaagcatttataaaaataggcttctcagatatgattgaagttgcctttgccgctgatatgctttcaattaaagaagctgttgaatttaatcatcatgtagaaaaaactggagatatattaataacatcttgctgttgccctatgtgggtggccatgttaagaaagtgttataaggatttagtaaaggatgtctccccttctgtttcacctatgatagctgctgggagagtaataaaaaaattaaataaagatgctaaggtagtttttataggtccctgtatagctaagaaagctgaagcaagagaaaaagacttagttggtgctatagattatgtcttaacctttgaagaattaaatggcatatttgaagcattaaaaatagatccatcatctatgaaaggtgttccctctatagaatacacctctagaggtggaaggctttacgctcgaactggaggggtatcagaggccataaatgatgtggttaaagaactctatcctgataaagctaagatatttaaggcagttcaagctaatggagttaaagaatgtaaagaactcttaaataaagttcaatctggtgaattaaaagcaaactttattgaaggtatgggatgtgttggtggatgcgttggtggtcctaaaagaatagtagatcctagcataggtaaaaaacacgttgatgaagttgcttataattctccaataaaggttgctactcatagccatactatggatgaagtactattaagattaggaataaattcattaaagtcttttgaggataaagaaaaaatatctatttttgaaagagaattctaa

SEQ ID NO: 165 - DNA, 1077 bp, Desulfitobacterium hafniense
atggcccaatcggaaattatgaaaattcgccgccaagtcttaaaatctgccctggactgggtcagtcatgaccagaaccgcaaggatcgcgccaccttggctcgtcagatcattcccgacggaacgccccgttaccgttgctgtattcataaagagcgggctgttatcgaggagcgtttaaaagctgttcttgaaccggatgaaggtccgatagtgcgtgttcttaaggaaggctgcaacggatgcgaaatgcatcgctatagtgtaaccgaccactgccagaattgtgttggtcatttctgtttcaccaactgtcctaaaaaagcaattctctttattaacaataaagcctttattgaccagacccgctgcgtcgaatgcggcctttgcgcccggaattgcccctatcatgccatcatcgagtatcggcggccctgtgaagacagctgcccgaccaaagccatctcggtccgggaggatcggattgccagtattgccgaagctcactgtaccagctgcggcaagtgcatcatcagctgccctttcggagccgtggccgaatcctcccagcttatccatctttttgaggcagtccgtaaccccgagcataagatctatgccgtcatcgcaccggcctttgtaggacaattcggaagaaaagtttcaccaggacaggtgaagtcggcccttctcaagctgggtttccaggatgttctggaagctgctctgggagccgatcggaccatcgaactggaagcccgggaatatgatgaacgcctggcccatggcgaagaattcatgaccagttcctgctgcccggcctatgtcagtgccgttatcaaagaaaaacctgatttattccaccacatttccagtacgctttccccgatggcccaggtggctcatatccttaaggaaaaagatcctgaagcaaagatcgcctttatcggaccctgtgtggccaaaaaagaagaaggcaaacggcctgaaacgaaagtggattttgtgcttacttttgaagaattgatggtctggcttgactatgcagggatcaatcctgccgaagaatccgagcaa

SEQ ID NO: 166 - DNA, 2373 bp, Geobacter metallireducens
gtgtgccattggttgcacagggaggcgggcctggtatatgatccagcggtggatcaggcaatcaacagagtgtcaggcctaacattatcagctgggagaaccatggaaccgatcattaccgtaaaagagaagtgccgtaaatgctactgctgtgtccggagttgcccggtcaaggcgatcaaggtggccaagagctacaccgagatcatcgtcgaccggtgcatcggctgcggcaactgtctcagcaactgcccccagcaggcaaagatggtggccgacaaggtgggggtgaccgaaaagctcctctcctcgggggaggaagttatcgccgtgctcggatcctcttttcccgcctttttccacaatgttacccccggtcagttggtggcgggcctcaggaagatcggctttgccgaggtccacgaaggatcctatggggccgaactgattgccgacgattatgcccgaatcacgtcggaaaagggacacccccgtatctcgtcccactgccctgccatcgtcgatctcatcgagcgccactacccgaagctcgtggggaacctcgtgccggtggtgtcccccatggtggccatggggcggtatctcaaggggaccctggggcagcacgtgagggttgtctacataagctcctgcgttgccaacaagctggaaacgcagacccaggagacccgcggcgccgttgacatcgttctgacctaccgggaactggagggtatcttccggagccgccagatagccctgccggcccttgccgacgagcccctcgacggaatcaggccgggggccggccggctttttcccattgccgacgggacgttccgggccttcggcatcccttttgatcccctggacaccgagatcgtcgccgcctgtggcgaggtgaacgtcatgggtatcatcaatgacctggcagctggccgcatctccccccggatcgccgacctccgtttctgctacgacggctgcatcggcggccccggcagaaaccgggcgcttacggagttttaccgccgcaaccgggtgattgcccacttcaagcaggaggtcccctgccggacggtccccaattccctccttgaggcagggcgggtctcctttggccgcagcttcgccagcaagtacgcgaaactggaggcccccaaggcgaacgacgtccgcaagatcctcaacgccaccaacaagttcacggtgaaggacgagctcaactgccgggcctgcggttaccgcacctgccgcgagtacgctgtggcagtctttcaggggctcgcggagattgagatgtgcctcccttacaacctccagcaactggaggaggaccgggggcgcctcattcagaagtacgagttggcgcggcgggaactggaacgggagtacggggacgagttcatcgtgggcaacgaccgcaagaccctggatgtgctcggcctcatcaaacaggtgggacccacccccacaacggttctcattcggggggagtcaggtaccggcaaggagctcaccgcccgggcgatccaccgctacagcaagcgcaacgacaaaccgctggttaccgtcaactgcaccactatcaccgactctctcctggagagcgaactctttggccacaagcggggagccttcaccggtgccgttgccgacaagaaagggctctttgaggccgccgacggggggacgatcttcctcgatgagatcggcgacataacccccaagctccaggcggagctcttgcgggttctcgatatgggggaggtgcgccccgtgggggggactgcagcaaaaaaggtggatgtgcgcctcattgccgccaccaacaagaacctggaacagggggtccgcgaggggtggttccgggaggatctctattaccggctcaacgtcttcaccattaccatgccccccctgcgaagccgcgtcgagtcgattcccattctggtccaccactttatggacaaggcaagcaccaagctcaacaagcggatggtcggcatcgaggaccgtgccgtcaaggcgctcacaaagtacccgtggcccggcaatatccgtgagatgcagaacgtcatcgagcgggctgccgttctcacccatgacggcgtgatccgggtcgagaactttccccttgccctctctgaggggcttgaggaggggttcgccacggggctcgacatccacgcagcatcgtttcggtccgagcgggagcaacatatggggaagctggagaaaaagcttatacagcgctacctgacggaggccaacggcaatatttcgcgggcggcgaagctggcaaacatcccccggcggaccttttatcggcttctcgataagtaccgcctcagggaacgggatgttcgctaa

SEQ ID NO: 167 - DNA, 1353 bp, Clostridium acetobutylicum
atgaataacaagtatatagaacttttcaaatcactcgtagattcctattacaacgatacttttgattcttttgtatatcacatcctttcagatgaagaggtagataaaaaagagctctcaaaagtaatatcatccttatgtggcgttagtgttgaatttaaagatactgaaacttacataagtgaattaaaaaaagcaatctcaaattataaatgtactgataacatagtagaaaaaatcaaagaatgcgattcttcttgtcacagcaacgaaggagaaactccctgccaaaaatcatgtccatttgatgctatactggtagataaaaacactaagacttcacacatacagaaagatttatgcacagattgcggcaactgtataacttcatgtccttctggatcaatattggataaaattgaatttatgcctctattaaatctatttaaaaataatgagacagtaatagctgctgtagcacctgccatagctggtcagtttggagaaaatgtttcacttgaaatgcttagaactgcttttaaaaaggttggatttgcagatatggtagaagtggctttttttgcagatatgcttactataaaggaagcttttgaatttaatgaactagtaaattcaaaggatgatttaatgataacctcttgttgttgcccaatgtgggtttccatgatacgaaaaatatacaaggatttagctagacacgtttcaccttcggtctctcctatgattgcctctggaagagttataaaaaaactaaatccaaattgcaaggtggtttttataggtccttgtattgctaaaaaagccgaatctagaagtcaagatataagtgatgcaatagatttcgtgcttaccttcgaagagttaaaaggtatatttgatgtactagatatagatccagaaaagctgccagaaacacatacaaagagttatgcctcaagagagggcagactttatggtcgcacaggtggagtatctacctctgtagatgaagctgtaaaaagaattttccctaacaaacatcatttatttaaatccacaaaagtagatggtgttaaggattgtaaggatatacttaataaaacgcaggctggtaatataggtgcaaattttttagaaggtatgggctgtgttggtggctgcgttggtggtccaaaagctatagttcacaaagatcagggacgtgaaagtgtaaataaaacagcagaaagttctgaaattaaaatatctgttgatagtgaacgaatgaaggatattttaagtcgaataggaattaactcaatagaagatttcggagataaatctaaagtagatatttttgaaagaagattttaa

SEQ ID NO: 168 - DNA, 321 bp, Shewanella oneidensis
atgaacaagaaaaaacacctatttgccgaggacagtttctttctgtcacgccgtaaatttatggctgtcggtgccgcgtttgtggccgcactcgcgatccccatcggctggtttaccagcaagcttgaacgccgtaatgagtacattaaggccagaagccaagggctatacaaggacgacagcctagcaaaaacccgcgtcagccatgctaaccccgcggtagaaaagtactacaaagaattcggtggcgagccattaggacatatgtcccacgagctactgcacacccactttgtcgatcgcaccaaattaagctcttga

SEQ ID NO: 169 - DNA, 1515 bp, Entamoeba histolytica
atgagtactcaacttactcctcttagaaataaaattatttcagaagttgtaaaatgttttaagagtggtagatttattgaagacattgataaattacctactattcttactgatggagatggatggaaaccaacatctaaatttgttcattcaagagaacaagaagaaggtatctatagagaaaaagttttatctgtccttggatttgttgatggagagtatgatgatataacaccactccatgtttatgcacaaaaggcattagagagaacttcattacatgagccagtttttggtatttcacaaaaaggatgtaacaaatgtcattttaatggttattttgttacacaagcttgtgaaggttgtacatctcgtccatgttctgttaattgtccaaaaaaatgtatttcatttggagaagatggaagagcagtaattaatcaaaataattgtattaaatgtggaagatgttacaaattctgtccatatggtgcaatcatatctaaatcagtaccttgtgtaaaagcatgtccttgtggagcaatgttagattctccagaaggagttaaaacaattgactttgaaaaatgtattaattgtggaggttgtatgagggcttgtccatttggagcaattcttccacgtagtaatcttattgatgttttaaaaatacttccaactaagaaagttgttgcatgtccagcaccatctatcgcagctcattttggtaaatatgatttagctttagtgtcaggtggattaattcaagttggatttacttctgtagaagatgttagttatggtgctgatttatgtgcattaaatgaagcaaaagaatttgaagaacgtattgttaaaaataaaaaagactttatgacaacttcttgttgtcctgcatatattaatgccattaataaacacatgccagagttaaaagaaaatgtttctcatactcctactccaatgcattttgctactcaagcagtcaaagatagagaccaagaaactgttacagtttttattggtccatgtaatgctaaacggtgggaaactttacaagattctactactgattattgtctaacatttgatgaaatatttggtttatttgaaggaagtggaatcgatttaagtaaagtacaaccatatacttttgtcgataaggcacataaagaaggaaaaatctttgctgtaagtggaggtgttgcatctgctgttgcatctttacttccaaaagaagtaccagatggagtaattaaaccaacaattattgatggattttctcaagaaaactttaaaagactaaagaatttcaaaaagaatattactggtaatcttgtcgaagttatggtttgtgaaggaggatgtgcttatggaccagggtgtcctggattgaatacaccagctacatcagctaaaattaaaatagctgtagataaaatggaagctcatccagaaggaagatgggttggtttaccaaattcccaaattaagccaataaaagtagaaaattaa

SEQ ID NO: 170 - DNA, 1683 bp, Cryptosporidium parvum
atgttttctactgcagtaaagctagcaaacttagatgattatctagaatcttctcaagattgtatagtttcacttttatcggataaagatgatacaaagccaaaaattgcagtgatgagacctgcaaaagcccaaggtaataaagatgataaaaaatcaggaactagtgataaggcaacagtaaatgtggcagattgtcttgcttgtagcggatgtgtaacttccgcggaagctaagctattagaggaccaaaatgtctcagaatttatgaatatacttaagcagaaaaggctaactgtggtatctatttcgaaccaatcatgctcttcttttgcctgccatctaaattgtgatctaataacaattcagagaaaattgtcggggttatttaaacatattggagctaggtttgtaatgaattcaacaatttccgagtatatttccttattagaaacaaagtacgagtttatttcaagatataaggcaaaatctgatctaccaatgattatttcacactgtccaggatggatttgctattctgaaaagagtttaaatagttctgtattacctttattgagtaaagttagatcagcacaacaattacaaggaattttgatcaagactttgactcttgaaatatataatcaattattatttctgtataaatttagattaagcaattcttatagaacaaatatgaatgttaaatcaacctttacacaaaacgataactttgttgaacaaagtgatatttttcatgttgctattatgccttgtcatgacaaaaaattggaatcaaccagaagttctctttctttgaagtcatctgataaaaattctagttgtcctgaagttgacatagtattagcaacatcggaagttggtgaaataataaaattagcagggtttaattcgctattggacgttccagaagctccactagataatttgtggcttaaccagaattttcaaattactaaaaagcataatctatctcttttaattactgaaaattatgtaagcaatcaaattctgaatcagttttcttggttgattccttcatattttaactcaaactcaggcggattctgtgaatatattataagaagtgcaatcaaagaacttgctggagatcatattgataataaagttcaactcccatttaataagttaaaaaatgatatcttagaagccaaatatattaaaaacaatgttgagctgaattattgccttgcttacggatttagggcaatccaatctatctctcgtaagcttaatttgcaaaagaacgcaagccaaaatactcagtataaacaaagcgttgtaaatcatgtaaattatcacttaattgaggctatggcatgcccaacaggatgcgtttctggcggaggccagatactttcacaaaacgatcaaaatgatgataactctgatttaaataagctaagaaaaaatataaagtttattgatgaggttcaggaagctttgtataaaggtattaatttaaataaaaatcaagaagttatactgccagatgaaattccaattgtgaatattttgtatgaatatctaattcatatagacaaacaaattgatagaagttctggcttaaaactcccttttcttaggaatgatttcgtatccattaatgaagtaccaactgcatcttcgttgaaatggtag

SEQ ID NO: 171 - DNA, 1410 bp, Kluyveromyces lactis
atgagtgcgttacttagggatgccgatttgaacgattttataagcccaggtttggcgtgtgtgaaaccagctcaacctcaaaaggttgagaagaaaccatcatttgaagttgaagttggcattgaatctagtgagcctgagaaggtatcgatcagtttgcaagactgtttagcctgtgctggttgcattacttcatcagaagagattttattatcgaagcaaagccataaggtgttcttagaaaaatggagcgaattggaagaactagatgaacgatctctagctgtcagcatatctcctcaatgtagactttcgttggctgactattactctatgtgccttgcagacctcgatcgatgtttccaaaatttcatgaaaaccaagttcaatgcgaaatatgttgttggtacccagtttggaaggtctatttcaatatcccggataaacgcaaccttaaaagacagggttccggaaaatgaaggccctcttttgtgtagtgtttgtcccggttttgtgttgtatgcagagaaaacgaaaccagaattaatacctcatatgttagatgtgaaatcacctcagcaaataacaggcaatctattgaaacaagcagatccaacatgctaccacttgagcataatgccatgttttgataaaaaactagaggcatctagagaagaatgtgaaaaagaagtagattgtgtgataacaccaaagcaatttgtagcaatgctcggagatctttcgatagatttcaagagttacatgacggaatatgattcatcaaaagagttatgtcccagcggatgggattataaacttcactggttaagtaacgaaggcagtagcagtggcggatatgcgtaccaataccttctttccttacagtcctcgaatcctgagtcagatattatcactattgaaggtaagaacagcgatgtgaccgagtacagattagtttctaagagtaaaggtgtaatagcctcgtcaagtgaggtatatgggtttagaaatatacaaaatttggttcgaaagctttcacaatcagcgtctgtaaaaaaaaggggaattaaagtgaaaaggcggggacaatcagtgttaaaatcaggagaaacatcagaaaagactacaaaggttttgacagcagatccagctaaaactgacttcgtcgaggttatggcttgtccaagcggctgtatcaacggcggtggtttacttaacgaagaaaaaaatgctaaccgccgtaaacaacttgcccaagacctatcgcttgcatacacgaaggttcattcggttaacatccctgacatagtccatgcatacgatgacaagtccaatgatttcaaatacaacctccgcgttatcgaaccgtctacttcttcagacgtggtcgcggtaggtaatacatggtag

SEQ ID NO: 172 - DNA, 1098 bp, Encephalitozoon cuniculi
atggatgccctcataagacctccaatgtccttctttgcagatctccccaaggataacaagaagtgcatcaagatcggcagcccactcgccctatctctaagcgactgccttgcgtgcagcgggtgtgtatctgcagatgaggctggggcactttcggaagatctttcgtttgtccttgacctgtcgcctcaaacttcctttgttctttctccgcagtcaaagataaacatcttcaacctttacagagaggatggcatggagtacagagaattcgaggctgtcctgtcttccttccttagaagtaagtttaacatacacaggatagtggacacctcctatctgagaagcaagatctacgaggaaacctatagggaatatatggccaccaaccacctgatagtcagtgcatgccctggagtcgtcacgtacattgagagaactgcgccctatctcattggatatctgtcgagggtgaagtctcctcagcagatggcgttttctcttgtaaaggggagcagaacggtgagtgtgatgccatgccaggacaagaagctggagaacggaagagatggtgttaagttcgactttatcctgacaacgagagggttctgtaaggctctcgactctcttgggttcaggagacctgccagagcgagcggcaagagcctctgtagtatggaggaagcagagacgactcaatggaacatcggaacgagctccggaggatatgctgagttcatacttgggaaacactgtgttgtggaaacaagggaaatcagaaatggcattaaggagcatctgctggatgacggaagaacaatatctcagatcacggggctggagaactctatcaactacttcaagagcagcaagaccaaagggccgagacacaaaatgacagagatattcctgtgcaagaacggctgcatcggagggcctgggcaggaaagagtcaacgatgtagagatggacatcagagaatatgatcgcaatggaagagaacagccaaggattttctactcatcacctgggctagaagaaaaaagggtgtttagagaggtaaaggcgaaaagagtggacctcagggttgattggtga

SEQ ID NO: 173 - DNA, 384 bp, Tritrichomonas foetus
  misc_feature (253)..(253): n is a, c, g, or t
  misc_feature (372)..(372): n is a, c, g, or t
atgtgcattaaagcatgcaattcagttgctggccaaggtgtcttgaaattagtcaaagttggaaacaaaaagttggtctcaacaaaaagtggcaagccactccaagaaacaaactgtattaaatgcggtcaatgtacattagtatgtggtccaggtgcattaacacaaaaggatgccattcaaaccgtaagtgaagttcttaagaatccaggagacaaagtccttgtttgccaaacagccccagccatcagantcaatttggccgatggtcttggaatgcctgccggttcgatcatcaccggaaaaatggtaaccgctctcaaaatgcttggctttaagtatgtcttcgatacaaacttcggaaccgatttnacaattggttga

SEQ ID NO: 174 - DNA, 1233 bp, Shewanella oneidensis
atgacaacgacaacttatcaaccaggagaaatccaagggctgatcaagattaatgcatccaaatgcaaaggatgtgatgcctgtaaacaattctgcccaacccatgccattaatggcgcttcgggtgcagtacactctatcgatgaagataaatgcttaagctgcggacagtgtttaattaactgtccatttagcgctattgaggaaacccacagcgcacttgaaaccgtgattaaaaagctcgctgataaaaataccaccgtggtcgggattatcgcgcctgcggtacgggtggcgattggtgaagaatttggcttaggtacaggtgagctagtaacaggcaaactctacggtgccatgaatcaagctggctttaaaattttcgactgtaacttcgccgccgatttgaccattatggaagaaggcagtgagtttattcatcgcctgcacgccaatgtaaaaggtgaagctaacgcaggcccattgccgcaatttacctcctgctgcccaggctgggtacgctacctcgaaacccgctaccctgcacttttacctaacctatcgaccgccaaatcacctcagcaaatggcagggactgtcgccaaaacctacggcgccaaggtatatcaaatgcagccagagaatattttcactgtctctgtaatgccttgcacctcgaaaaagctcgaagcctcccgtcccgaatttaactcggcttggcaatatcatcaggaacacggcgcaaactcgccctcctaccaagatattgatgccgtgctcaccacaagggaaatggctcagttactcaaactgctcgatatcgatctcgcgaataccgcggaatatcaaggcgatagtttgttctctgaatacactggcgcgggcacaatttttggaacaaccggcggggtgatggaagcggcgctgcgtaccgcccataaagtactgactggaactgaaatggctaagctggaatttgaacccgtacgcgggctaaaaggcgtgaaatcagcctctgtcagcctgtttgatacagagcttaaccaagatgtgaccgtcaatgtcgccgtagtgcacgacatgggcaacaacattgagcccgtactgcgcgatgtgatggctggcacctctccttatcactttattgaggtgatgaactgcgctggcggttgcgtcaacggcggaggccaacctattgaaggtaaaggctcttcatggctgggtaacatttaa

SEQ ID NO: 175 - protein, 261 aa, Pyrococcus furiosus
MGKVRIGFYALTSCYGCQLQLAMMDELLQLIPNAEIVCWFMIDRDSIEDEKVDIAFIEGSVSTEEEVELVKKIRENAKIVVAVGACAVQGGVQSWSEKPLEELWKKVYGDAKVKFQPKKAEPVSKYIKVDYNIYGCPPEKKDFLYALGTFLIGSWPEDIDYPVCLECRLNGHPCILLEKGEPCLGPVTRAGCNARCPGFGVACIGCRGAIGYDVAWFDSLAKVFKEKGMTKEEIIERMKMFNGHDERVEKMVEKIFSGGEQ

SEQ ID NO: 176 - protein, 252 aa, Escherichia coli
MSPVLTQHVSQPITLDEQTQKMKRHLLQDIRRSAYVYRVDCGGCNACEIEIFAAITPVFDAERFGIKVVSSPRHADILLFTGAVTRAMRMPALRAYESAPDHKICVSYGACGVGGGIFHDLYSVWGGSDTIVPIDVWIPGCPPTPAATIHGFAVALGLLQQKIHAVDYRDPTGVTMQPLWPQIPPSQRIAIEREARRLAGYRQGREICDRLLRHLSDDPTGNRVNTWLRDADDPRLNSIVQQLFRVLRGLHD

SEQ ID NO: 177 - protein, 236 aa, Methanothermobacter thermautotrophicus
MAEENAKPRIGYIHLSGCTGDAMSLTENYDILAELLTNMVDIVYGQTLVDLWEMPEMDLALVEGSVCLQDEHSLHELKELREKAKLVCAFGSCAQTGCFTRYSRGGQQAQPSHESFVPIADLIDVDLAIPGCPPSPEIIAKAVVALLNNDMEYLQPMLDLAGYTEACGCDLQTKVVNQGLCTGCGTCAMACQTRALDMTNGRPELNSDRCIKCGICYVQCPRSWWPEEQIKKELGL

SEQ ID NO: 178 - protein, 259 aa, Methanosarcina barkeri
MANKIKLGHVHLSGCTGCLVSVADNYQGFLKILDDYADLVYCLTLADVRHIPEMDVALVEGSVCIQDRESVEDIKETRKKSRIVVALGSCASYGNITRFCRGGQHNHPQHESYLPIGDLIDVDVYIPGCPPSPELIRNVAIMAYLLLEGNEEQKDLAGRYLKPLMDLAKRGTTGCFCDLMDDVINQGLCIGCGICAASCPVRAITHEFGKPQGDLNLCIKCGSCYGACPRSFFNPDVISEFESINEIIAGALKEGEKDD

SEQ ID NO: 179 - protein, 142 aa, Rhodospirillum rubrum
MNFLSRMSKKSPWLYRINAGSCNGCDVELATTACIPRYDVERLGCQYCGSPKHADIVLVTGPLTARVKDKVLRVYEEIPDPKVTVAIGVCPISGGVFRESYSIVGPIDRYLPVDVNVPGCPPRPQAIIEGIAKAIEIWAGRI

SEQ ID NO: 180 - protein, 428 aa, Pyrococcus furiosus
MKNLYLPITIDHIARVEGKGGVEIIIGDDGVKEVKLNIIEGPRFFEAITIGKKLEEALAIYPRICSFCSAAHKLTALEAAEKAVGFVPREEIQALREVLYIGDMIESHALHLYLLVLPDYRGYSSPLKMVNEYKREIEIALKLKNLGTWMMDILGSRAIHQENAVLGGFGKLPEKSVLEKMKAELREALPLAEYTFELFAKLEQYSEVEGPITHLAVKPRGDAYGIYGDYIKASDGEEFPSEKYRDYIKEFVVEHSFAKHSHYKGRPFMVGAISRVINNADLLYGKAKELYEANKDLLKGTNPFANNLAQALEIVYFIERAIDLLDEALAKWPIKPRDEVEIKDGFGVSTTEAPRGILVYALKVENGRVSYADIITPTAFNLAMMEEHVRMMAEKHYNDDPERLKILAEMVVRAYDPCISCSVHVVRL

SEQ ID NO: 181 - protein, 555 aa, Escherichia coli
MNVNSSSNRGEAILAALKTQFPGAVLDEERQTPEQVTITVKINLLPDVVQYLYYQHDGWLPVLFGNDERTLNGHYAVYYALSMEGAEKCWIVVKALVDADSREFPSVTPRVPAAVWGEREIRDMYGLIPVGLPDQRRLVLPDDWPEDMHPLRKDAMDYRLRPEPTTDSETYPFINEGNSDARVIPVGPLHITSDEPGHFRLFVDGEQIVDADYRLFYVHRGMEKLAETRMGYNEVTFLSDRVCGICGFAHSVAYTNSVENALGIEVPQRAHTIRSILLEVERLHSHLLNLGLSCHFVGFDTGFMQFFRVREKSMTMAELLIGSRKTYGLNLIGGVRRDILKEQRLQTLKLVREMRADVSELVEMLLATPNMEQRTQGIGILDRQIARDLRFDHPYADYGNIPKTLFTFTGGDVFSRVMVRVKETFDSLAMLEFALDNMPDTPLLTEGFSYKPHAFALGFVEAPRGEDVHWSMLGDNQKLFRWRCRAATYANWPVLRYMLRGNTVSDAPLIIGSLDPCYSCTDRVTLVDVRKRQSKTVPYKEIERYGIDRNRSPLK

SEQ ID NO: 182 - protein, 405 aa, Methanothermobacter thermautotrophicus
MSERIVISPTSRQEGHAELVMEVDDEGIVTKGRYFSITPVRGLEKIVTGKAPETAPVIVQRICGVCPIPHTLASVEAIDDSLDIEVPKAGRLLRELTLAAHHVNSHAIHHFLIAPDFVPENLMADAINSVSEIRKNAQYVVDMVAGEGIHPSDVRIGGMADNITELARKRLYARLKQLKPKVDEHVELMIGLIEDKGLPKGLGVHNQPTLASHQIYGDRTKFDLDRFTEVMPESWYDDPEIAKRACSTIPLYDGRNVEVGPRARMVEFQGFKERGVVAQHVARALEMKTALARAIEILDELDTSAPVRADFDERGTGKLGVGAIEGPRGLDVHMAQVENGKIQFYSALVPTTWNIPTMGPATEGFHHEYGPHVIRAYDPCLSCATHVMVVDDEDRSVIRDEMVRL

SEQ ID NO: 183 - protein, 456 aa, Methanosarcina barkeri
MTKVVEISPTTRHEGHSKLTLKVNDEGIVERGDWLSTTPVRGIEKLAIGKTMDQVPKIASRVCGICPIAHTLAGIEAMEASIGCEIPKDAKLLRVILHAANRLHSHALHNILILPDFYIPDTETKINPFSKEQPLRSVAVRIFRIREIAQTIGAVAGGEAIHPSNPRVGGMYRNVSSRAKQKIADLAKEGLVLAHEQMEFMIEVIRNMQDREFVEVAGKQIPLPKTLGYHNQGVMATAPMYGSSSLDEKPMWDFTRWRETRPWDWYMSEETIDLEDSSYPIGGTTKVGTKVNPRMEACNTVPTYDGQPVEVGPRARLATFKHFTEKGTFAQHIARQMEYTDCYYTILNCLENLDTSGKVLADTIPLGNGSMGWAANEAPRGTDVHLARVKDGKVLRYEMLVPTTWNFPTCSRALTGAPWQIAEMVIRAYDPCVSCATHMIVVNEEDRIVAQKLMQW

SEQ ID NO: 184 - protein, 361 aa, Rhodospirillum rubrum
MSTYTIPVGPLHVALEEPMYFRIEVDGEKVVSVDITAGHVHRGIEYLATKRNIYQNIVLTERVCSLCSNSHPQTYCMALESITGMVVPPRAQYLRVIADETKRVASHMFNVAILAHIVGFDSLFMHVMEAREIMQDTKEAVFGNRMDIAAMAIGGVKYDLDKDGRDYFIGQLDKLEPTLRDEIIPLYQTNPSIVDRTRGIGVLSAADCVDYGLMGPVARGSGHAYDVRKQAPYAVYDRLDFEMALGEHGDVWSRAMVRWQEALTSIGLIRQCLRDMPDGPTKAGPVPPIPAGEAVAKTEAPRGELIYYLKTNGTDRPERLKWRVPTYMNWDALNVMMAGARISDIPLIVNSIDPCISCTER

SEQ ID NO: 185 - DNA, 786 bp, Pyrococcus furiosus
atgggaaaagttaggattggattttacgcattaacctcgtgctacggctgtcaattgcagctagctatgatggacgagttattacaacttatcccaaatgctgaaatagtttgctggttcatgattgatagagatagcattgaggatgaaaaggtcgacatagcttttatagaaggaagcgtttcaactgaggaagaagttgaactcgtgaaaaaaattagggagaatgcaaagatcgtcgttgcggttggagcttgtgctgttcaaggaggagttcagagctggagtgaaaagccattagaagagctctggaagaaggtttatggagacgcaaaagtcaagttccaaccgaagaaggctgaaccagtttcaaaatacataaaagttgactacaacatctacggttgcccaccagagaagaaggacttcctctacgccctgggaacattcttgattggttcatggccagaggatatagattatccagtttgtctagaatgtaggctcaatggacatccatgtatccttcttgagaaaggagaaccctgtctaggtccagtaacaagggcaggatgtaacgcgagatgtccaggatttggagttgcgtgtataggatgcagaggggcaatagggtacgatgtagcttggttcgactctctagctaaggtgttcaaggagaaggggatgacaaaagaggagataattgagagaatgaaaatgttcaatggacatgatgagagggttgagaaaatggttgaaaaaatattctcaggtggtgaacaatga

SEQ ID NO: 186 - DNA, 759 bp, Escherichia coli
atgagtccagtgcttacacaacatgtcagccagcccatcacgctggacgagcaaacgcaaaagatgaagcggcatttgctacaggatatccgtcgctcggcttacgtttatcgcgtcgattgcggcggctgcaacgcctgtgaaatcgaaatttttgctgccattacaccagtattcgacgcagaacgttttggcattaaggttgtttcatcaccgcgtcacgccgatattttgttatttactggcgcagtcacccgggcgatgcgtatgcctgcacttcgggcgtatgagtctgcccccgatcataaaatttgtgtttcctacggcgcgtgcggtgtcggcggcggtattttccacgatctctacagcgtctggggcggtagcgacaccattgtccccattgatgtttggatccccggctgcccgccaacaccggccgccaccattcacggtttcgccgtggcgctcggtttgctgcaacagaagattcacgctgtggattatcgcgatcccaccggggtgactatgcaaccgttgtggccgcagatcccgccatcacagcgtatcgccattgagcgagaagcgcggcggctggcgggctatcgtcaggggcgagaaatttgcgatcggctcctgcgccatttaagcgacgatcctacaggaaatcgggttaacacctggttgcgcgatgccgacgatccacgtctcaatagtatcgttcagcaactctttcgcgtactccgggggttacatgactga

SEQ ID NO: 187 - DNA, 711 bp, Methanothermobacter thermautotrophicus
atggctgaagaaaatgcaaaaccaagaataggttacattcacctcagtggatgtaccggagatgccatgtcgttaactgaaaattacgacattctagcagaattactcaccaacatggtggacatagtatacggacagaccctggtggatctctgggagatgccagagatggatctggcccttgttgagggatctgtctgtctgcaggacgaacacagcctgcacgaactcaaagaactgagggagaaggcaaaactcgtctgcgccttcggttcatgcgcacagacaggctgcttcacaaggtactcaaggggcggacagcaggcacagccatcacacgagtcctttgtaccaatagcagacctcatagatgtggacctcgccattccagggtgcccaccatcacctgagataatagcaaaggcagtcgttgcactcctcaacaatgacatggagtacctccagccaatgctggaccttgcaggctacacagaggcatgcggatgcgacctccagacaaaggttgtaaaccagggtctctgcactggatgtggaacatgtgcaatggcctgccagacaagggcccttgacatgaccaacggaagacccgaactcaacagcgaccgctgtataaaatgtggaatctgctatgtgcagtgcccaagaagctggtggccagaagaacagatcaaaaaggagttagggctatag

SEQ ID NO: 188 - DNA, 780 bp, Methanosarcina barkeri
atggcaaataagatcaagctcgggcatgtacacttgagcggctgtaccggctgtctcgtgtccgtggccgataactaccagggatttctcaagatcctggacgactatgccgaccttgtctactgcctcactcttgctgacgtccggcatattccagagatggacgtggcactcgtcgagggatcggtctgtatccaggaccgtgaatctgtggaggatataaaggagacgcggaagaagtccaggatcgtggtggccctcggctcctgcgcgagctatggtaatatcaccaggttctgccgtggaggacagcataatcatccccagcacgagtcttaccttccgatcggggatctcattgacgtggatgtttacatcccaggatgccctccgagcccggagcttataaggaacgtcgccatcatggcgtacctgctccttgaagggaacgaggaacagaaggatcttgcgggcaggtacttaaagcctctcatggaccttgcgaagcgcggcactaccggatgcttctgcgacctgatggacgacgtgattaaccagggcctctgcataggctgtggcatctgtgctgcatcctgtccagtgcgggcgatcacgcacgagttcggaaagccgcagggtgaccttaacctctgcatcaagtgcggctcctgctatggcgcctgcccaaggtcgttcttcaaccctgatgtgatttctgaattcgagagcatcaacgagataattgctggagcgcttaaggaaggtgagaaggatgattga

SEQ ID NO: 189 - DNA, 429 bp, Rhodospirillum rubrum
atgaattttctttcgcgtatgtccaagaagtcgccctggctttaccgcatcaacgccggatcgtgtaacggctgcgatgtcgagctggcgaccaccgcctgcattccgcgctatgacgtcgaacgccttggctgtcagtactgcggcagccccaagcacgccgatatcgtgctggtcaccggccctttgaccgcccgggtcaaggacaaggtgctgcgggtctatgaggaaatccccgatcccaaggtcaccgtagccatcggggtttgcccgatctcgggcggggtgttccgggaaagctacagcatcgtcggcccgatcgaccgttatctgcccgtcgatgtcaacgtgccgggctgtccgccgcgcccccaggcgatcatcgaggggatcgccaaagccatcgaaatttgggccggtcggatctag

SEQ ID NO: 190 - DNA, 1287 bp, Pyrococcus furiosus
atgaagaacctctatcttccaatcaccattgatcatatagcaagagttgaggggaagggtggtgtggagataataattggggatgatggagtcaaggaggtcaagctaaacataattgaagggcccagattctttgaggccataactattgggaagaagcttgaggaagctctggccatttacccgagaatatgctcattctgttcagccgcccacaagttaaccgcattagaggctgcagaaaaggccgtcggttttgtcccaagggaagagatacaggcccttagagaagtactatacatcggagacatgatagagagtcatgcccttcacctatatcttctagttcttcccgactacaggggctactcgagcccacttaagatggtgaatgaatacaagagggagatagagatagcccttaagctgaagaaccttggcacctggatgatggacattctagggtcaagagccatacaccaagaaaatgcggttttgggcggattcggaaagctccctgagaagagtgtccttgagaaaatgaaagccgagcttagggaagccctaccacttgccgagtatacttttgagttatttgcaaagcttgagcagtacagcgaagttgaagggccaataacacacttggccgtgaagccgaggggagatgcttatggaatttatggagattacataaaggcaagtgatggggaggagttcccaagtgaaaagtacagagattatataaaggagttcgtcgttgaacacagttttgcaaagcacagtcactacaagggcagacccttcatggttggggctatatctagagttattaacaatgctgacctcctatacggcaaggccaaggagctgtatgaggcaaacaaagacctattgaagggaacaaatccgtttgcaaataacttagcccaggccctcgaaatagtttactttatagagagggcaatagatctgctcgacgaggctctcgccaagtggccaattaagcccagggatgaagttgagataaaggacggctttggtgtctcaacgactgaggctccaaggggaatcttagtctatgccctcaaagttgagaatggaagggtttcttatgccgacataataacacctacagcattcaacttggcaatgatggaagaacatgtaagaatgatggcagaaaagcactacaatgacgatccagaaaggttaaagatactggctgagatggttgttagggcttatgatccatgcatatcttgctcagtccacgtggttagactttaa

SEQ ID NO: 191 - DNA, 1668 bp, Escherichia coli
gtgaacgttaattcatcgtcaaatcgtggcgaagcgattctcgccgccctgaaaacgcagttccccggcgcggtgctggatgaagagcgacaaacgcctgaacaggtcaccattacggtgaaaatcaatctgctgcctgacgttgtacagtatctttattatcaacatgatggctggcttccggtcctgtttggcaacgacgagcggacacttaacggtcattacgcggtttattatgccctttcaatggaaggggccgaaaaatgctggattgtggtgaaggcgctggtcgatgccgacagtcgggagtttccgtcagtcacaccgcgcgtccctgccgcggtctggggcgagcgagaaattcgcgatatgtacgggctgattccggttggcctgccggatcagcgtcgcctggtgttgcccgatgactggccggaagatatgcatccgctgcgcaaagatgcgatggattatcgactgcgccctgaaccgacgactgattccgaaacgtatccgtttatcaatgagggcaacagcgatgcgcgggtgatccctgtcggcccgctgcatatcacctccgatgaaccgggtcacttccgcttgtttgtggatggcgagcaaattgtcgatgctgattaccgcctgttttatgtccatcgcggcatggagaaactggcagaaacgcggatgggctacaacgaagtgaccttcttatcggaccgcgtgtgtgggatttgcggttttgcccacagtgtggcctataccaattcggttgaaaatgcactggggattgaggtgccgcaacgagcacatactattcgctcgattctgctggaagtcgaacggctacacagtcatttgcttaaccttggcctctcctgccatttcgttggttttgataccggctttatgcaatttttccgcgtgcgggaaaagtcgatgacgatggcggaattgctgatcgggtcgcgtaaaacctacggtctgaatctgattggtggtgttcgccgcgatattctcaaagagcaacgtctgcaaacgctgaaactggtgcgcgagatgcgcgccgacgtgtcggagctggtagagatgctgcttgctacgccgaatatggaacaacgcactcagggcattggcattctcgaccgacaaatcgcccgtgatttgcgctttgatcacccctacgccgactacggcaatattccaaaaacactgtttacctttaccggcggcgatgttttctcccgcgtgatggtccgtgtcaaagagacgtttgattcgctggcaatgctggaatttgccctcgacaacatgccggataccccactgctgaccgaaggctttagctataaacctcacgcattcgcgctgggctttgttgaagcgccacgcggtgaagacgtgcactggagcatgctcggtgataaccaaaaattgttccgctggcgctgccgtgccgccacctacgccaactggccggtgttgcgttacatgctgcgcggcaataccgtttctgacgcaccgctgattatcggtagccttgatccctgctactcctgtaccgaccgtgtgacgctggtagatgtgcgcaagcgccagtcaaaaaccgtgccgtataaagagatcgaacgctacggcattgatcgtaaccgttcgccgctgaagtaa

SEQ ID NO: 192 - DNA, 1218 bp, Methanothermobacter thermautotrophicus
atgagcgaaaggattgttatatcgccgacatcacgacaagaaggacatgcagaacttgtcatggaagtcgatgatgagggaatcgtgacaaaggggcgatacttcagtattactcctgtcaggggccttgagaaaatagtgacaggtaaagcacctgaaacagcacctgtcatcgtccagaggatatgtggagtatgccctataccacacaccctggcttccgttgaggcaatagacgactcccttgacattgaggttccaaaggccggaagacttctccgtgaacttacacttgcagcacaccacgtaaacagccacgcaatacatcacttcctcatagcaccggacttcgtgcctgaaaacctcatggcagacgccataaactcagtctccgagataaggaaaaacgcacagtacgtagttgacatggttgcaggtgagggtatacacccatccgatgtcaggataggtggaatggccgacaacataacggaactcgcaaggaaaaggctgtatgcgaggttaaagcagctcaaaccaaaagtcgacgaacacgttgaactcatgataggattaatcgaggataagggccttccaaagggccttggagtccacaaccagccaacacttgcaagccaccagatctacggtgacaggacaaaattcgatctggacaggttcaccgaggtaatgcctgagagctggtacgatgaccctgaaatagccaagagggcctgctcaacaataccactctacgatggaagaaacgtggaggtcggtccaagagcaaggatggttgaattccagggattcaaggagaggggtgttgttgcacagcacgttgcaagggcacttgagatgaaaacggcactcgcaagggcaattgaaatccttgatgaactggacacatccgcaccggtaagggcagacttcgatgagagaggcacaggtaaactgggtgtaggtgcaattgaaggtccaaggggactggacgttcacatggcccaggttgaaaatggtaagatacagttctacagtgcactcgtcccaacaacctggaacatcccaacaatgggtcctgcaactgaaggattccaccatgaatacgggccacacgtcatacgcgcttacgacccctgtctctcatgcgcaacacacgtgatggttgttgatgatgaggacagatcagtaatcagggatgaaatggtcagactctag

SEQ ID NO: 193 - DNA, 1371 bp, Methanosarcina barkeri
atgacaaaagttgtagagatctctccaaccacgagacatgaaggccactccaagctcaccctgaaggtgaatgatgaaggtattgttgagcgaggagattggctctccaccaccccggtcaggggtattgaaaagctcgctataggtaagacgatggaccaggtcccgaagattgcttctcgggtctgcggtatctgtcccattgcccacaccctggcgggcattgaggctatggaggcttcgatcggctgcgagatccccaaggatgcaaagcttctgagggtcattcttcatgcagcaaaccgcctccacagccatgctctacacaacatcctgatcctcccggacttttacattccagatacggagacgaagatcaacccgttttctaaggagcagcctttaaggagcgttgcggtgaggatcttccgcatccgcgagattgcacagaccattggagctgttgcaggcggagaggctatccacccttcaaacccgagggttggcggaatgtaccgcaacgtgagttcacgagcaaagcagaagatagctgacctggcaaaagaaggtcttgtccttgcccacgaacagatggaattcatgattgaggtcatcaggaacatgcaggaccgggagtttgtcgaggtcgcaggcaagcagatcccgcttcccaagacgctcggataccataaccagggggtcatggccacagctccaatgtacggctcgtccagtctggacgaaaagcctatgtgggatttcactcgttggagagaaacccggccatgggactggtacatgagtgaggaaaccattgatcttgaagactcgagctatccgattggcggcaccacgaaggtcggcaccaaagtcaaccctcggatggaagcctgcaatactgttccgacctacgacggccagccagttgaggtcggcccgagggcaaggctcgctaccttcaagcactttaccgagaaaggtacctttgctcagcacatcgccaggcagatggagtacaccgactgctactacaccatcctcaactgccttgaaaacctggatacttctggcaaggtccttgctgacaccatccctctgggaaacggatccatgggctgggccgcgaacgaagccccgcgcgggaccgatgtccatctcgcacgggtgaaggatggaaaggtgctgcggtacgagatgcttgtacctaccacctggaacttccctacctgcagccgcgctctgactggagcaccctggcagatcgccgaaatggttatccgtgcttatgacccgtgcgtctcgtgtgcaacccatatgatagtagtgaacgaagaggatagaatagtcgcccaaaaactcatgcagtggtga

SEQ ID NO: 194 - DNA, 1086 bp, Rhodospirillum rubrum
atgagcacctataccattcccgtcggcccgctgcatgtggcccttgaagagccgatgtacttccgcatcgaggtcgatggcgagaaggtggtcagcgtcgatatcaccgccggccatgtccatcgcggcatcgaatacctggcgaccaagcgcaacatctatcaaaatatcgtgctgaccgagcgcgtctgctcgctctgctccaacagccatccgcaaacttattgcatggccctggaaagcatcaccggcatggtggtgccgccgcgcgcccaatatctgcgggtgatcgccgacgagaccaagcgcgtcgcctcgcatatgttcaacgtcgccatccttgcccatatcgtcggttttgattcgctgttcatgcatgtcatggaagcccgcgagatcatgcaagacaccaaggaagcggtctttggcaatcgcatggacatcgccgccatggcgatcggcggggtcaaatacgatcttgataaggacgggcgcgattatttcatcggtcagctcgataagcttgaaccaacgctgcgcgacgagatcatcccgctttatcagaccaacccgtcgatcgttgatcgcacccggggcattggcgttctgagcgcggccgattgcgtggactatggcctgatggggccggtggcgcgcggctcgggccatgcctatgacgtgcgcaagcaggcgccctatgcggtttatgatcgtctggacttcgagatggccctgggcgagcacggcgatgtgtggtcgcgcgccatggtgcgctggcaagaggccctgacctcgatcgggctgatccgccaatgcctgcgcgacatgcccgacggtccgacgaaggcggggccggtgccgcccattcccgctggcgaggcggtcgccaagaccgaggcgccgcgcggcgagttgatctattacctgaagaccaacggcaccgaccggcccgaacgcctgaaatggcgcgttcccacctatatgaactgggatgcgctcaatgtgatgatggccggggcgcggatttccgatatcccgctgatcgtcaacagcatcgatccctgcatctcctgtacggaacgctga

SEQ ID NO: 195 - DNA, 1563 bp, Rhodospirillum rubrum
atgcgccccgtgcagcgcccccgccgctggcccggcctgcgccagcgcctgagccccgagcgccccgtggaccgccgcagccgccgccgcagcggcgccgcccgccccggccgccgccgcggcagcggcgtgcagcacgagatcctgcgcagcgtgagccagcgcgacatgagcatgagcatccagcccaccgtgaccatcgaccccgagctgtgcaccggctgcggccgctgcgtggagacctgccccgtgcaggccatcgccggcagccgcggcaaggcccacgagatcgaggccgccgcctgcgtgagctgcggccgctgcgtggccacctgcgccgccttcgacagcatcttcgacgccttccccaccccccgccccgtgcgcctgaagcgccgcggcctgcccggcagcctgaaggagcccctgttcgccgcccacgaccccagccgcatcgaggccgtgcgcaaggccttcgccacccccaagcgcatgaccgtgatgcaggtggacaccatggcctgcgtggccctggccgaggacttcggcctgccccccggcagcctgagccccctgaagatcgccagcgccgcccgccagctgggcttcgaccgcgtgtaccgcaccagcttccccgccggcctggccgtgctggagaccgcccacgagatggccgcccgcctggccaacggcggcaacctgcccgtgatcaacagcagctgccccgccgtggtggccttcctggagcgccgctaccccgagctgctgcactacctgagcaccgtgaagagcccccaccagatcgccggcgccctgtacaacagctacctggccgacgccgccaacctggcccccgccaacatccacaaggtgagcgtggtggcctgcctgagccacaaggccgaggccgagcgccccgagatgatgacctgcggctgccccgacatcgacaccgtgctgaccgcccgcgagctggccatcctgatcaaggacgccggcatcgacgtgcccctgctgggcgacggcgagttcgacaacgacttccccgagatcgagggcctggacaccctgtactgcgcccccggcgacgtgagccgcgccgtgctgggcgccggccgctggttcctgggccagggcgagggcgtgggcgcccccgccggcgagaccgtggaggtgctggacgaggccacccgcctgacccgcctggcctaccccggcggcaccctgcaggccctgaccgtggccggcttcgacaaggccgtgccctacctggaggccatcaaggccggccgcaacgccttccagttcctggagatcgccagctgcccccagggctgcgccagcggcgccggcctgcccaaggtgctgctggagaccgagaagcccgcccgctaccgcgcccgcatcgagaacctgccccccgccgcccccgaggcctggagccgcctgcccggccaccccagcatcgtggccctgtacggcggctacttcggcaaggccatcggcgacaagagcaaccgccgcctgcacacccagtacgccgagcccgccgccgccccctaa

SEQ ID NO: 196 - DNA, 1725 bp, Clostriduim pasteuranum
atgaagaccatcatcatcaacggcgtgcagttcaacaccgacgaggacaccaccatcctgaagttcgcccgcgacaacaacatcgacatcagcgccctgtgcttcctgaacaactgcaacaacgacatcaacaagtgcgagatctgcaccgtggaggtggagggcaccggcctggtgaccgcctgcgacaccctgatcgaggacggcatgatcatcaacaccaacagcgacgccgtgaacgagaagatcaagagccgcatcagccagctgctggacatccacgagttcaagtgcggcccctgcaaccgccgcgagaactgcgagttcctgaagctggtgatcaagtacaaggcccgcgccagcaagcccttcctgcccaaggacaagaccgagtacgtggacgagcgcagcaagagcctgaccgtggaccgcaccaagtgcctgctgtgcggccgctgcgtgaacgcctgcggcaagaacaccgagacctacgccatgaagttcctgaacaagaacggcaagaccatcatcggcgccgaggacgagaagtgcttcgacgacaccaactgcctgctgtgcggccagtgcatcatcgcctgccccgtggccgccctgagcgagaagagccacatggaccgcgtgaagaacgccctgaacgcccccgagaagcacgtgatcgtggccatggcccccagcgtgcgcgccagcatcggcgagctgttcaacatgggcttcggcgtggacgtgaccggcaagatctacaccgccctgcgccagctgggcttcgacaagatcttcgacatcaacttcggcgccgacatgaccatcatggaggaggccaccgagctggtgcagcgcatcgagaacaacggccccttccccatgttcaccagctgctgccccggctgggtgcgccaggccgagaactactaccccgagctgctgaacaacctgagcagcgccaagagcccccagcagatcttcggcaccgccagcaagacctactaccccagcatcagcggcctggaccccaagaacgtgttcaccgtgaccgtgatgccctgcaccagcaagaagttcgaggccgaccgcccccagatggagaaggacggcctgcgcgacatcgacgccgtgatcaccacccgcgagctggccaagatgatcaaggacgccaagatccccttcgccaagctggaggacagcgaggccgaccccgccatgggcgagtacagcggcgccggcgccatcttcggcgccaccggcggcgtgatggaggccgccctgcgcagcgccaaggacttcgccgagaacgccgagctggaggacatcgagtacaagcaggtgcgcggcctgaacggcatcaaggaggccgaggtggagatcaacaacaacaagtacaacgtggccgtgatcaacggcgccagcaacctgttcaagttcatgaagagcggcatgatcaacgagaagcagtaccacttcatcgaggtgatggcctgccacggcggctgcgtgaacggcggcggccagccccacgtgaaccccaaggacctggagaaggtggacatcaagaaggtgcgcgccagcgtgctgtacaaccaggacgagcacctgagcaagcgcaagagccacgagaacaccgccctggtgaagatgtaccagaactacttcggcaagcccggcgagggccgcgcccacgagatcctgcacttcaagtacaagaagtaa

SEQ ID NO: 197 - DNA, 1266 bp, Desulfovibrio vulgaris
atgagccgcaccgtgatggagcgcatcgagtacgagatgcacacccccgaccccaaggccgaccccgacaagctgcacttcgtgcagatcgacgaggccaagtgcatcggctgcgacacctgcagccagtactgccccaccgccgccatcttcggcgagatgggcgagccccacagcatcccccacatcgaggcctgcatcaactgcggccagtgcctgacccactgccccgagaacgccatctacgaggcccagagctgggtgcccgaggtggagaagaagctgaaggacggcaaggtgaagtgcatcgccatgcccgcccccgccgtgcgctacgccctgggcgacgccttcggcatgcccgtgggcagcgtgaccaccggcaagatgctggccgccctgcagaagctgggcttcgcccactgctgggacaccgagttcaccgccgacgtgaccatctgggaggagggcagcgagttcgtggagcgcctgaccaagaagagcgacatgcccctgccccagttcaccagctgctgccccggctggcagaagtacgccgagacctactaccccgagctgctgccccacttcagcacctgcaagagccccatcggcatgaacggcgccctggccaagacctacggcgccgagcgcatgaagtacgaccccaagcaggtgtacaccgtgagcatcatgccctgcatcgccaagaagtacgagggcctgcgccccgagctgaagagcagcggcatgcgcgacatcgacgccaccctgaccacccgcgagctggcctacatgatcaagaaggccggcatcgacttcgccaagctgcccgacggcaagcgcgacagcctgatgggcgagagcaccggcggcgccaccatcttcggcgtgaccggcggcgtgatggaggccgccctgcgcttcgcctacgaggccgtgaccggcaagaagcccgacagctgggacttcaaggccgtgcgcggcctggacggcatcaaggaggccaccgtgaacgtgggcggcaccgacgtgaaggtggccgtggtgcacggcgccaagcgcttcaagcaggtgtgcgacgacgtgaaggccggcaagagcccctaccacttcatcgagtacatggcctgccccggcggctgcgtgtgcggcggcggccagcccgtgatgcccggcgtgctggaggccatggaccgcaccaccacccgcctgtacgccggcctgaagaagcgcctggccatggccagcgccaacaaggcctaa

SEQ ID NO: 198 - DNA, 1407 bp, Entamoeba histolytica
atgccccccaagcccagccacaccctgaccggccacgaccacaaccacagcatccagttcgactggagcaagtgcatgggctgcggcatgtgcgccaccaagtgcaccttcggcgtgctggtgaagcagccccccaagatcccccccttcgtgcagcccaaccgcgagaagctgagccaggagaacaccgacaagacccgcgtgctgatcgacgagagcgagtgcaccggctgcggccagtgcagcctggtgtgcaacttcggcagcatcacccccatcgaccacctggtggacaccttcaaggccaaggaggccggcaagaagctggtggccatgatcgcccccagcacccgcctgggcgtggccgaggccatgggcatgcccatcggcagcaccgccatggcccagctggtgcactgcctgcgcctgatcggcttcgactacgtgttcgacgtggacgccggcgccgacaagaccaccatggacgactacgccgaggtgatcgagatgaagaaggagggcaagggccccgccatcaccagctgctgccccgcctggatcgagctggtggagaaggagtaccccgacctgatccccaacgtgagcaccgcccgcagccccatcggctgcctggccggctgcatcaagcgcggctgggccaaggacgtgggcatcgccgtggaggacctgtacaccgtgggcatcatgccctgcatcgccaagaagaccgagagccagcgccagcagatccaccaggactacgacgccagctgcaccagcaacgagatcgccgcctacttcaagaagcacctgccccccgaggagtgcaagttcacccaggagcgcgaggaggccctggccaagaccgaggacggccagtgcgacctgcccttccgccgcatcagcggcggcagcaacatcttcggcaagaccggcggcgtgtgcgagaccgtgctgcgcgtgatcgcccgcaacgccggcgtggactggaacagctgcaccgtgaacaaggaggagaccttcaagcacgccgccagcggcagcaccatgaccaacctgagcgtggacatcggcggcaccatcatcaccggcgccgtgtgccacggcggctacgccatccgccacgcctgcgagctgatccgcaagggcgagctgaaggtggacgtggtggagatgatggcctgcgtgggcggctgcctgggcggcgccggccagcccaagatcccccccgccaagaagctggagatggacaagcgccgcgtgatgctggacatcctggaccagcagaccgacatccgcgccgccaacgagaacaccgacgtgctgggctggatcgacaagcacttcgaccaccagggcgcccaccagcacctgcacacctacttcaccccccgctaccagaactaa

SEQ ID NO: 199 - DNA, 1350 bp, Scenedesmus obliquus
atgcccgagtggcagcccggcggccgctacgccgtgagcgtgcgcccccccgtgaaccgccgcgccgtggtggccgccgagcgccgccgcctggtggtgcgcgccgccggccccaccgccgagtgcgactgcccccccgcccccgcccccaaggccccccactggcagcagaccctggacgagctggccaagcccaaggagcagcgcaaggtgatgatcgcccagatcgcccccgccgtgcgcgtggccatcgccgagaccatgggcctgaaccccggcgacgtgaccgtgggccagatggtgaccggcctgcgcatgctgggcttcgactacgtgttcgacaccctgttcggcgccgacctgaccatcatggaggagggcaccgagctgcgccaccgcctgcaggaccacctggagcagcaccccaacaaggaggagcccctgcccatgttcaccagctgctgccccggctgggtggccatggtggagaagagcaaccccgagctgatcccctacctgagcagctgcaagagcccccagatgatgctgggcgccgtgatcaagaactacttcgccgccgaggccggcgccaagcccgaggacatctgcaacgtgagcgtgatgccctgcgtgcgcaagcagggcgaggccgaccgcgagtggttcaacaccaccggcgccggcggcgccaacgtggaccacgtgatgaccaccgccgagctgggcaagatcttcgtggagcgcggcatcaagctgaacgacctgcaggagagccccttcgacaaccccgtgggcgagggcagcggcggcggcgtgctgttcggcaccaccggcggcgtgatggaggccgccctgcgcaccgtgtacgaggtggtgacccagaagcccctggaccgcatcgtgttcgaggacgtgcgcggcctggagggcatcaaggagagcaccctgcacctgacccccggccccaccagccccttcaaggccttcgccggcgccgacggcaccggcatcaccctgaacatcgccgtggccaacggcctgggcaacgccaagaagctgatcaagcagctggccgccggcgagagcaagtacgacttcatcgaggtgatggcctgccccggcggctgcatcggcggcggcggccagccccgcagcgccgacaagcagatcctgcagaagcgccaggccgccatgtacgacctggacgagcgcgccgtgatccgccgcagccacgagaaccccctgatcggcgccctgtacgagaagttcctgggcgagcccaacggccacaaggcccacgagctgctgcacacccactacgtggccggcggcgtgcccgacgagaagtaa

SEQ ID NO: 200 - DNA, 1311 bp, Chlorella fusca
atgtgctgccccgtggtggccagccgccacgccggccgcgcccgccacgtggccgtgcgcgccgccggccccaccagcgagtgcgactgcccccccaccccccaggccaagctgccccactggcagcaggccctggacgagctggccaagcccaaggagagccgccgcctgatgatcgcccagatcgccagcgccgtgcgcgtggccatcgccgagaccatcggcctggcccccggcgacgtgaccatcggccagctggtgaccggcctgcgcatgctgggcttcgactacgtgttcgacaccctgttcggcgccgacctgaccatcatggaggagggcaccgagctgctgcaccgcctgcaggaccacctggagcagcaccccaacaaggaggagcccctgcccatgttcaccagctgctgccccggctgggtggccatggtggagaagagcaaccccgagctgatcccctacctgagcagctgcaagagcccccagatgatgctgggcgccgtgatcaagaactactacgcccagcaggtgggcgtgcagcccagcgacatctgcaacgtgagcgtgatgccctgcgtgcgcaagcagggcgaggccgaccgcgagtggttcaacaccaccggcgccggcctggcccgcgacgtggaccacgtggtgaccaccgccgaggtgggcaagatcttcctggagcgcggcatcaagctgaacgagctgcccgagagcaacttcgacaaccccatcggcgagggcaccggcggcgccctgctgttcggcaccaccggcggcgtgatggaggccgccctgcgcaccgtgtacgaggtggtgacccagaagcccatgggccgcgtggacttcgaggaggtgcgcggcctggagggcatcaaggaggccgagatcaccctgaagcccggcgacgacagccccttcaaggccttcgccggcgccgacggccagggcatcaccctgaagatcgccgtggccaacggcctgggcaacgccaagaagctgatcaagagcctgagcgagggcaaggccaagtacgacttcatcgaggtgatggcctgccccggcggctgcatcggcggcggcggccagccccgcagcaccgacaagcagatcctgcagaagcgccagcaggccatgtacaacctggacgagcgcagcaccatccgccgcagccacgacaaccccttcatccaggccctgtacgacaagttcctgggcgcccccaacagccacaaggcccacgacctgctgcacacccactacgtggccggcggcatccccgaggagaagtaa

SEQ ID NO: 201 - DNA, 1725 bp, Clostridium saccharobutylicum
atgatcaacatcgtgatcgacgagaagaccatccaggtgcaggagaacaccaccgtgatccaggccgccctggccaacggcatcgacatccccagcctgtgctacctgaacgagtgcggcaacgtgggcaagtgcggcgtgtgcgccgtggagatcgagggcaagaacaacctggccctggcctgcatcaccaaggtggaggagggcatggtggtgaagaccaacagcgagaaggtgcaggagcgcgtgaagatgcgcgtggccaccctgctggacaagcacgagttcaagtgcggcccctgcccccgccgcgagaactgcgagttcctgaagctggtgatcaagaccaaggccaaggccaacaagcccttcgtggtggaggacaagagccagtacatcgacatccgcagcaagagcatcgtgatcgaccgcaccaagtgcgtgctgtgcggccgctgcgaggccgcctgcaagaccaagaccggcaccggcgccatcagcatctgcaagagcgagagcggccgcatcgtgcaggccaccggcggcaagtgcttcgacgacaccaactgcctgctgtgcggccagtgcgtggccgcctgccccgtgggcgccctgaccgagaagacccacgtggaccgcgtgaaggaggccctggaggaccccaacaagcacgtgatcgtggccatggcccccagcatccgcaccagcatgggcgagctgttcaagctgggctacggcgtggacgtgaccggcaagctgtacgccagcatgcgcgccctgggcttcgacaaggtgttcgacatcaacttcggcgccgacatgaccatcatggaggaggccaccgagttcatcgagcgcgtgaagaacaacggccccttccccatgttcaccagctgctgccccgcctgggtgcgccaggtggagaactactaccccgagttcctggagaacctgagcagcgccaagagcccccagcagatcttcggcgccgccagcaagacctactacccccagatcagcggcatcagcgccaaggacgtgttcaccgtgaccatcatgccctgcaccgccaagaagttcgaggccgaccgcgaggagatgtacaacgagggcatcaagaacatcgacgccgtgctgaccacccgcgagctggccaagatgatcaaggacgccaagatcaacttcgccaacctggaggacgagcaggccgaccccgccatgggcgagtacaccggcgccggcgtgatcttcggcgccaccggcggcgtgatggaggccgccctgcgcaccgccaaggacttcgtggaggacaaggacctgaccgacatcgagtacacccagatccgcggcctgcagggcatcaaggaggccaccgtggagatcggcggcgagaactacaacgtggccgtgatcaacggcgccgccaacctggccgagttcatgaacagcggcaagatcctggagaagaactaccacttcatcgaggtgatggcctgccccggcggctgcgtgaacggcggcggccagccccacgtgagcgccaaggagcgcgagaaggtggacgtgcgcaccgtgcgcgccagcgtgctgtacaaccaggacaagaacctggagaagcgcaagagccacaagaacaccgccctgctgaacatgtactacgactacatgggcgcccccggccagggcaaggcccacgagctgctgcacctgaagtacaacaagtaa

SEQ ID NO: 202 - DNA, 1266 bp, Desulfovibrio vulgaris
atgagccgcatcgagatggagaagatcttctacgaggaccacgcccccgaccccaaggccgaccccgacaagctgttcttcatccagatcgacgagagcaagtgcatcggctgcgacagctgccagcagtactgccccaccggcgccatcttcggcgacaccggcgacgcccacaagatcccccacgaggagctgtgcatcaactgcggccagtgcctgacccactgccccgtgggcgccatctacgagagccagagctgggtgaccgagatcgagaagaagatcaaggccaaggacgtgaaggtgatcgccatgcccgcccccgccgtgcgctacgccctgggcgacgccttcggcctgcccgtgggcaccgtgaccaccggcaagatgttcagcgccctgaaggagctgggcttcgaccactgctgggacaacgagttcaccgccgacgtgaccatctgggaggagggcaccgagttcgtgcagcgcctgaccaagaagctggacaagcccctgccccagttcaccagctgctgccccggctggcacaagtacgtggagagcctgtaccccgagctgttcccccacatgagcagctgcaagagccccatcggcatgctgggcaccctggccaagacctacggcgccgaccgcatgaagtacgaccgcgccaaggtgtacaccgtgagcatcatgccctgcaccgccaagaagtacgagggcatgcgcccccagctgtgggacagcggccacaaggacatcgacgccaccatcgacacccgcgagctggcctacatgatcaagaaggccaagatcgacttcaccaagctgcccgacggcaagcgcgacaccctgatgggcgagagcaccggcggcgccaccctgttcggcgtgaccggcggcgtgatggaggccgccctgcgctacgcctaccaggccgtgaccggcaagaagcccgagagcatggacttcaagggcgtgcgcggcctgcagggcgtgaaggaggccaccgtgaacgtgggcggcgtggacgtgaaggtggccgtggtgcacggcgcccgccgcttccacgacgtgtgcgagctggtgaaggccggcaaggccccctggcacttcatcgagttcatggcctgccccggcggctgcgtgtgcggcggcggccagcccgtgatgcccggcgtgctggaggccgccgaccgccgcagcacccgcatgtacgccggcctgaagaagcgcctggccatggccagcgccagccgcgcctaa

SEQ ID NO: 203 - DNA, 375 bp, Desulfovibrio vulgaris
atgcagatcgtgaacctgacccgccgcggcttcctgaaggccgcctgcgtggtgaccggcggcgccctgatcagcatccgcatgaccggcaaggccgtggccgccgccaagcagctgaaggactacatgatggaccgcatcaacggcgtgtacggcgccgacgccaagttccccgtgcgcgccagccaggacaacgtgcaggtgcagaagctgtacgccgacttcctggagaagcccatgagccacaaggccgagcagctgctgcacacccactgggtggaccgcagcaaggccatcgagcgcatgaaggcccagggcgcctaccccaacccccgcgccaaggagttcgagggcaacacctacccctacgagtaa

SEQ ID NO: 204 - DNA, 1821 bp, Desulfovibrio vulgaris
atgaacgccttcatcaacggcaaggaggtgcgctgcgagcccggccgcaccatcctggaggccgcccgcgagaacggccacttcatccccaccctgtgcgagctggccgacatcggccacgcccccggcacctgccgcgtgtgcctggtggagatctggcgcgacaaggaggccggcccccagatcgtgaccagctgcaccacccccgtggaggagggcatgcgcatcttcacccgcacccccgaggtgcgccgcatgcagcgcctgcaggtggagctgctgctggccgaccacgaccacgactgcgccgcctgcgcccgccacggcgactgcgagctgcaggacgtggcccagttcgtgggcctgaccggcacccgccaccacttccccgactacgcccgcagccgcacccgcgacgtgagcagccccagcgtggtgcgcgacatgggcaagtgcatccgctgcctgcgctgcgtggccgtgtgccgcaacgtgcagggcgtggacgccctggtggtgaccggcaacggcatcggcaccgagatcggcctgcgccacaaccgcagccagagcgccagcgactgcgtgggctgcggccagtgcaccctggtgtgccccgtgggcgccctggccggccgcgacgacgtggagcgcgtgatcgactacctgtacgaccccgagatcgtgaccgtgttccagttcgcccccgccgtgcgcgtgggcctgggcgaggagttcggcctgccccccggcagcagcgtggagggccaggtgcccaccgccctgcgcctgctgggcgccgacgtggtgctggacaccaacttcgccgccgacctggtgatcatggaggagggcaccgagctgctgcagcgcctgcgcggcggcgccaagctgcccctgttcaccagctgctgccccggctgggtgaacttcgccgagaagcacctgcccgacatcctgccccacgtgagcaccacccgcagcccccagcagtgcctgggcgccctggccaagacctacctggcccgcaccatgaacgtggcccccgagcgcatgcgcgtggtgagcctgatgccctgcaccgccaagaaggaggaggccgcccgccccgagttccgccgcgacggcgtgcgcgacgtggacgccgtgctgaccacccgcgagttcgcccgcctgctgcgccgcgagggcatcgacctggccggcctggagcccagcccctgcgacgaccccctgatgggccgcgccaccggcgccgccgtgatcttcggcaccaccggcggcgtgatggaggccgccctgcgcaccgtgtaccacgtgctgaacggcaaggagctggcccccgtggagctgcacgccctgcgcggctacgagaacgtgcgcgaggccgtggtgcccctgggcgagggcaacggcagcgtgaaggtggccgtggtgcacggcctgaaggccgcccgccagatggtggaggccgtgctggccggcaaggccgaccacgtgttcgtggaggtgatggcctgccccggcggctgcatggacggcggcggccagccccgcagcaagcgcgcctacaaccccaacgcccaggcccgccgcgccgccctgttcagcctggacgccgagaacgccctgcgccagagccacaacaaccccctgatcggcaaggtgtacgagagcttcctgggcgagccctgcagcaacctgagccaccgcctgctgcacacccgctacggcgaccgcaagagcgaggtggcctacaccatgcgcgacatctggcacgagatgaccctgggccgccgcgtgcgcggcgacagcgactaa

SEQ ID NO: 205 - DNA, 1719 bp, Clostridium perfringens
atgaacaagatcatcatcaacgacaagaccatcgagttcgacggcgacaagaccatcctggacctggcccgcgagaacggcttcgacatccccgtgctgtgcgagctgaagaactgcggcaacaagggccagtgcggcgtgtgcctggtggagcaggagggcaacgaccgcctgctgcgcagctgcgccatcaaggccaaggacggcatggtgatcaagaccgacagcgagaaggtgctggaggcccgcaaggagcgcgtggccgagctgctggacgagcacgagttcaagtgcggcccctgcaagcgccgcgagaactgcgagttcctgaagctggtgatcaagaccaaggcccgcgcccacaagcccttcgtggtggccgacaagagcgagtacgtggacgaccgcagcaagagcatcgtgctggaccgcagcaagtgcgtgaagtgcggccgctgcgtggccgcctgccgcacccgcaccgccaccaacagcatcaagttccaccgcatcgacggcgtgcgcctggtgggccccgaggagctgaagtgcttcgacgacaccaactgcctgctgtgcggccagtgcatcgccgcctgccccgtggacgccctgagcgagaagagccacatcgagcgcgtgcaggaggccctgaacgaccccgagaagcacgtgatcgtggccatggcccccgccgtgcgcaccagcatgggcgagctgttcaagatgggctacggccaggacgtgaccggcaagctgtacaccgccctgcgcgagctgggcttcgacaaggtgttcgacatcaacttcggcgccgacatgaccatcatggaggaggccaccgagctgatcgagcgcatcaagaacaacggccccttccccatgctgaccagctgctgccccagctgggtgcgcgaggtggagaactacttccccgagctggtggagaacctgagcagcgccaagagcccccagcagatcttcggcgccgccagcaagacctactacccccaggtggccgacatcgaccccaagaaggtgttcaccgtgaccgtgatgccctgcaccagcaagaagttcgaggccgaccgccccgagatggagaacgagggcatccgcaacatcgacgccgtgatcaccacccgcgagctggcccgcatgatcaaggccgccaagatcgacttcgccaagctggaggacggcgaggtggaccccgccatgggcgagtacaccggcgccggcgtgatcttcggcgccaccggcggcgtgatggaggccgccctgcgcaccgccaaggacttcatggagaacgacaacctggacaacgtggactacgaggccgtgcgcggcctggccggcatcaaggaggccgaggtggagatcgccggcaacgagtacaagctggccgtggtgagcggcgccgccaacgtgttcgagctggtgaagagcggcaagatcaacgactaccacttcatcgaggtgatggcctgccccggcggctgcgtgaacggcggcggccagccccacatcagcgccgaggacagcgacaagatggacatccgcgaggtgcgcgccagcgtgctgtacaaccaggacaagaacctggagaagcgcaagagccaccagaacagcgccctgctgaagatgtacgagagctacatgggcaagcccggccacggccgcgcccacgagctgctgcacatgaagtacaagaagtaa

SEQ ID NO: 206 - DNA, 1719 bp, Clostridium perfringens
atgaacaagatcatcatcaacgacaagaccatcgagttcgacggcgacaagaccatcctggacctggcccgcgagaacggcttcgacatccccgtgctgtgcgagctgaagaactgcggcaacaagggccagtgcggcgtgtgcctggtggagcaggagggcaacgaccgcctgctgcgcagctgcgccatcaaggccaaggacggcatggtgatcaagaccgacagcgagaaggtgctggaggcccgcaaggagcgcgtggccgagctgctggacgagcacgagttcaagtgcggcccctgcaagcgccgcgagaactgcgagttcctgaagctggtgatcaagaccaaggcccgcgcccacaagcccttcgtggtggccgacaagagcgagtacgtggacgaccgcagcaagagcatcgtgctggaccgcagcaagtgcgtgaagtgcggccgctgcgtggccgcctgccgcacccgcaccgccaccaacagcatcaagttccaccgcatcgacggcgtgcgcctggtgggccccgaggagctgaagtgcttcgacgacaccaactgcctgctgtgcggccagtgcatcgccgcctgccccgtggacgccctgagcgagaagagccacatcgagcgcgtgcaggacgccctgaacgaccccgagaagcacgtgatcgtggccatggcccccgccgtgcgcaccagcatgggcgagctgttcaagatgggctacggccaggacgtgaccggcaagctgtacaccgccctgcgcgagctgggcttcgacaaggtgttcgacatcaacttcggcgccgacatgaccatcatggaggaggccaccgagctgatcgagcgcatcaagaacaacggccccttccccatgctgaccagctgctgccccagctgggtgcgcgaggtggagaactacttccccgagctggtggagaacctgagcagcgccaagagcccccagcagatcttcggcgccgccagcaagacctactacccccaggtggccgacatcgaccccaagaaggtgttcaccgtgaccgtgatgccctgcaccagcaagaagttcgaggccgaccgccccgagatggagaacgagggcatccgcaacatcgacgccgtgatcaccacccgcgagctggcccgcatgatcaaggccgccaagatcgacttcgccaagctggaggacggcgaggtggaccccgccatgggcgagtacaccggcgccggcgtgatcttcggcgccaccggcggcgtgatggaggccgccctgcgcaccgccaaggacttcatggagaacgacaacctggacaacgtggactacgaggccgtgcgcggcctggccggcatcaaggaggccgaggtggagatcgccggcaacgagtacaagctggccgtggtgagcggcgccgccaacgtgttcgagctggtgaagagcggcaagatcaacgactaccacttcatcgaggtgatggcctgccccggcggctgcgtgaacggcggcggccagccccacatcagcgccgaggacagcgacaagatcgacatccgcgaggtgcgcgccagcgtgctgtacaaccaggacaagaacctggagaagcgcaagagccaccagaacagcgccctgctgaagatgtacgagaactacatgggcaagcccggccacggccgcgcccacgagctgctgcacatgaagtacaagaagtaa

SEQ ID NO: 207 - DNA, 1455 bp, Megasphaera elsdenii
atgcccgagttccacagccgcttcgagaagatcgaccgccgcgtgcccatcgacgagcacaactgcgccgtgcagttcgacgtgaccaagtgcaagaactgcaccctgtgccgccgcgcctgcgccgacacccagaccgtgctggactactacagcctgagcagcaccggcgacatgcccatctgcgtgcactgcggccagtgcagcagcgcctgccccttcggcgccatcgtggaggtgaacgacgtggacaaggtgaaggccgccctgaaggaccccgagaagatcgtgatcttccagaccgcccccgccgtgcgcgtgggcctgggcgaggccttcggcatggaccccggcaccttcgtggagggcaagatggtggccgccctgcgcaccctgggcgccgactacgtgttcgacaccgacttcggcgccgacctgaccatcatggaggaggccaccgagctgctgcaccgcctgcagagcgaggagatccccatcccccagttcaccagctgctgccccgcctgggtggagttcgccgagaccttctaccccgacctgctgcagcacctgagcagcaccaagagccccatcagcatcctgagccccgtgatcaagacctacttcgcccagcagaagaacatcgaccccaagaagatcgtgaacgtgtgcgtgaccccctgcaccgccaagaaggccgagatccgccgccccgagctgagcgccagcggcctgttctgggacgagcccgagatccgcgacaccgacatctgcatcaccacccgcgagctggcccagtggatccaggacgagaacatcgacttcgccagcctggaggacagcaagttcgacaaggccttcggcgaggccagcggcggcggccgcatcttcggcaacagcggcggcgtgatggaggccgccatccgcaccgcctaccacatgttcaccggccgccccgcccccaaggacttcatccccttcgagcccgtgcgcggcctgcagggcgtgaagaaggccaccgtgatcttcggccacttcgtgctgcacgtggccgccatcagcggcctgggcaacgcccgcgccttcatcgacgacctgatcaagaacgacgccttcgaggactacagcttcatcgaggtgatggcctgccccggcggctgcatcggcggcggcggccagcccaaggtgaagctgccccaggtgaagaaggtgcaggaggcccgcaccgccagcatctacaagagcgacgaggagaccgacatcaaggccagctggcagaaccccgagatcgagaccctgtacgaggccttcctggacgagcccctgagcgagatggccgagttcaccctgcacacctacttcagcgacaagagcgaccagctgggccgcatgaagaacctgaccccccagaccaaccccatgagccccaagtacaagccccccaccgaggagtaa

SEQ ID NO: 208 - DNA, 1266 bp, Desulfovibrio desulfuricans strain G20
atgaacctggtggagatggagaagatccagtacgtggaccagagccccgacccccgcgccaaccccgacgagctgttcttcatccagatcgaccccgagaagtgcatcggctgcgacacctgccaggagtactgccccaccggcgccatcttcggcgacaccggcagcgcccacagcatcccccacgaggagatctgcatcaactgcggccagtgcctgacccactgccccgtgggcgccatctacgaggtgcagagctgggtgcgcgagctgagcgagaagatcaaggaccccgagatcaaggtgatcgccatgcccgcccccgccgtgcgctacggcctgggcgagtgcttcggcatgcccgtgggcaccgtgaccaccggcaagatgctgaccgccctgcagatgctgggcttcgaccacgtgtgggacaacgagttcaccgccgacgtgaccatctgggaggagggcaccgagttcgtgaaccgcctgaccggccagatcgacaagcccctgccccagttcaccagctgctgccccggctggcacaagtacgtggagagcttctaccccgagctgttcccccacctgagcagctgcaagagccccatcggcatgatgggcgccctggccaagacctacggccccgacgtgatgaagtacgaccgcagcaaggtgtacaccgtgagcatcatgccctgcaccgccaagaagtacgagggcatgcgcgccgacctgtggagcagcggctacaaggacatcgacgccaccatcgacacccgcgagctggcctacatgatcaagaaggccggcatcgacttcgccgccctgcccgacggcaagcgcgacaccctgatgggcgacagcaccggcggcgccaccatcttcggcgtgagcggcggcgtgatggaggccgccctgcgctacgcctacgaggccgtgaccggcaagaagcccagcagctgggacttcaccatggtgcgcggcctgaacggcatcaaggagggcaccgtgaccatcggcgacgccaagatcaacgtggccgtggtgcacggcgccaagcgcttcgccgaggtgtgcgaggtgatcaagaccggcaagagcccctggcacttcatcgagttcatggcctgccccggcggctgcgtgtgcggcggcggccagcccgtgatgcccggcgtgctggaggccatggaccgcaaggtgagccgcaccttcgccggcctgaaggagcgcctgaaccgcatgagcagcagcaaggcctaa

SEQ ID NO: 209 - DNA, 1758 bp, Desulfovibrio fructosovorans
atgagcatgctgaccatcaccatcgacggcaagaccaccagcgtgcccgagggcagcaccatcctggacgccgccaagaccctggacatcgacatccccaccctgtgctacctgaacctggaggccctgagcatcaacaacaaggccgccagctgccgcgtgtgcgtggtggaggtggagggccgccgcaacctggcccccagctgcgccacccccgtgaccgacaacatggtggtgaagaccaacagcctgcgcgtgctgaacgcccgccgcaccgtgctggagctgctgctgagcgaccaccccaaggactgcctggtgtgcgccaagagcggcgagtgcgagctgcagaccctggccgagcgcttcggcatccgcgagagcccctacgacggcggcgagatgagccactaccgcaaggacatcagcgccagcatcatccgcgacatggacaagtgcatcatgtgccgccgctgcgagaccatgtgcaacaccgtgcagacctgcggcgtgctgagcggcgtgaaccgcggcttcaccgccgtggtggcccccgccttcgagatgaacctggccgacaccgtgtgcaccaactgcggccagtgcgtggccgtgtgccccaccggcgccctggtggagcacgagtacatctgggaggtggtggaggccctggccaaccccgacaaggtggtgatcgtgcagaccgcccccgccgtgcgcgccgccctgggcgaggacctgggcgtggcccccggcaccagcgtgaccggcaagatggccgccgccctgcgccgcctgggcttcgaccacgtgttcgacaccgacttcgccgccgacctgaccatcatggaggagggcagcgagttcctggaccgcctgggcaagcacctggccggcgacaccaacgtgaagctgcccatcctgaccagctgctgccccggctgggtgaagttcttcgagcaccagttccccgacatgctggacgtgcccagcaccgccaagagcccccagcagatgttcggcgccatcgccaagacctactacgccgacctgctgggcatcccccgcgagaagctggtggtggtgagcgtgatgccctgcctggccaagaagtacgagtgcgcccgccccgagttcagcgtgaacggcaaccccgacgtggacatcgtgatcaccacccgcgagctggccaagctggtgaagcgcatgaacatcgacttcgccggcctgcccgacgaggacttcgacgcccccctgggcgccagcaccggcgccgcccccatcttcggcgtgaccggcggcgtgatcgaggccgccctgcgcaccgcctacgagctggccaccggcgagaccctgaagaaggtggacttcgaggacgtgcgcggcatggacggcgtgaagaaggccaaggtgaaggtgggcgacaacgagctggtgatcggcgtggcccacggcctgggcaacgcccgcgagctgctgaagccctgcggcgccggcgagaccttccacgccatcgaggtgatggcctgccccggcggctgcatcggcggcggcggccagccctaccaccacggcgacgtggagctgctgaagaagcgcacccaggtgctgtacgccgaggacgccggcaagcccctgcgcaagagccacgagaacccctacatcatcgagctgtacgagaagttcctgggcaagcccctgagcgagcgcagccaccagctgctgcacacccactacttcaagcgccagcgcctgtaa

SEQ ID NO: 210 - DNA, 1266 bp, Desulfovibrio fructosovorans
atgagccgcatcgagatggccaagatcttctacgagcagaccgtgcccccccccggcaccaacctggaccaggcctacatcgtgcaggtggacgagaccaagtgcatcggctgcgacacctgcatgggctactgccccaccggcgccatcaccggcgagagcggcgagccccacaaggtggtggaccccgccgcctgcatcaactgcggccagtgcctgacccactgccccgtggccgccatctacgagaccgtgagcttcgtgcccgagatcgaggccaagctgaaggacaagaacgtgaaggtgatcgccatgcccgcccccgccgtgcgctacgccctgggcgaccccttcggcatgcccctgggcgccgtgaccaccgagcacatgctgaccggcctgaagcagctgggcttcgacaacgtgtgggacaacgagttcaccgccgacgtgaccatctgggaggagggcagcgagctgctggcccgcatcaccaagaagctggacaagcccctgccccagttcaccagctgctgccccggctggcagaagtacgccgagaccttctaccccgagctgctgccccacttcagcagctgcaagagccccatcggcatgatgggccccctggccaagacctacggcgccaaggagctgggctacgagcccaagcagatctacaccgtgagcatcatgccctgcaccgccaagaagttcgagggcatgcgccccgagatggacgccagcggcttccgcgacatcgacgccaccatcaacacccgcgagctggcctacatgatgaagaaggccggcatcgacctgcccaagatcgccaacggcaagcgcgacgccgtgatgggcgagagcaccggcggcgccaccatcttcggcgtgagcggcggcgtgatggaggccgccctgcgcttcgcctaccaggccctgaccaagaagcccccccagagctgggacttcaaggccgtgcgcggcctgaacggcatcaaggaggccaccatcaacatcggcggcaccgacgtgaaggtggccgtggtgaacggcggcaagaacttcgccaaggtgtgcgacgaggtgaaggccggcaagagcccctaccacttcatcgagttcatggcctgccccggcggctgcgtgatgggcggcggccagcccatcatgcccaccgtgctggagagcatgaaccgcaccaccaccaagttctacgccagcctgaagaagcgcctggccctgtacgacgcccagaaggcctaa

SEQ ID NO: 211 - DNA, 1827 bp, Thermotoga maritima
atgcgccgcttcttcaagaacaacctgcgcaacctgagccagaacggcgagaccaacagcgtgcgccgctgcttcgccctggccgacgtgaccgtggtgatcaacggccgcaccctgaccgtgcccgacaacctgaccgtgatcgaggcctgcgagaaggccggcatcgagatccccgccctgtgccaccacccccgcctgggcgagagcatcggcgcctgccgcgtgtgcgtggtggaggtggagggcgcccgcaacctgcagcccgcctgcgtgaccaaggtgcgcgacggcatggtgatcaagaccagcagcgaccgcgtgaagaccgcccgcaagttcaacctggccctgctgctgagcgagcaccccaacgactgcatgacctgcgaggccaacggccgctgcgagttccaggacctgatctacaagtacgacgtggagcccatcttcggctacggcaccaaggagggcctggtggaccgcagcagccccgccatcgtgcgcgacctgagcaagtgcatcaagtgccagcgctgcgtgcgcgcctgcagcgagctgcagggcatgcacatctacagcatggtggagcgcggccaccgcacctaccccggcacccccttcgacatgcccgtgtacgagaccgactgcatcggctgcggccagtgcgccgccttctgccccaccggcgccatcgtggagaacagcgccgtgaaggtggtgctggaggagctggagaagaaggagaagatcctggtggtgcagaccgcccccagcgtgcgcgtggccatcggcgaggagttcggctacgcccccggcaccatcagcaccggccagatggtggccgccctgcgccgcctgggcttcgactacgtgttcgacaccaacttcggcgccgacctgaccatcatggaggagggcagcgagttcctggagcgcctggagaagggcgacctggaggacctgcccatgttcaccagctgctgccccggctgggtgaacctggtggagaaggtgtaccccgagctgcgcacccgcctgagcagcgccaagagcccccagggcatgctgagcgccatggtgaagacctacttcgccgagaagctgggcgtgaagcccgaggacatcttccacgtgagcatcatgccctgcaccgccaagaaggacgaggccctgcgcaagcagctgatggtgaacggcgtgcccgccgtggacgtggtgctgaccacccgcgagctgggcaagctgatccgcatgaagaagatccccttcgccaacctgcccgaggaggagtacgacgcccccctgggcatcagcaccggcgccgccgccctgttcggcgtgaccggcggcgtgatggaggccgccctgcgcaccgcctacgagctgaagaccggcaaggccctgcccaagatcgtgttcgaggaggtgcgcggcctgaagggcgtgcgcgaggccgagatcgacctggacggcaagaagatccgcatcgccgtggtgcacggcaccgccaacgtgcgcaacctggtggagaagatcctgcgccgcgaggtgaagtaccacttcgtggaggtgatggcctgccccggcggctgcatcggcggcggcggccagccctacagccgcgaccccgagatcctgcgcaagcgcgccgaggccatctacaccatcgacgagcgcatgaccctgcgcaagagccacgagaaccccgccatcaagaagctgtacgaggagtacctggagcaccccctgagccacaaggcccacgagctgctgcacacctactacgaggaccgcagccgcaagaagcgcctggccgtgaagtaa

SEQ ID NO: 212 - DNA, 1938 bp, Thermotoga maritima
atgaagatctacgtggacggccgcgaggtgatcatcaacgacaacgagcgcaacctgctggaggccctgaagaacgtgggcatcgagatccccaacctgtgctacctgagcgaggccagcatctacggcgcctgccgcatgtgcctggtggagatcaacggccagatcaccaccagctgcaccctgaagccctacgagggcatgaaggtgaagaccaacacccccgagatctacgagatgcgccgcaacatcctggagctgatcctggccacccacaaccgcgactgcaccacctgcgaccgcaacggcagctgcaagctgcagaagtacgccgaggacttcggcatccgcaagatccgcttcgaggccctgaagaaggagcacgtgcgcgacgagagcgcccccgtggtgcgcgacaccagcaagtgcatcctgtgcggcgactgcgtgcgcgtgtgcgaggagatccagggcgtgggcgtgatcgagttcgccaagcgcggcttcgagagcgtggtgaccaccgccttcgacacccccctgatcgagaccgagtgcgtgctgtgcggccagtgcgtggcctactgccccaccggcgccctgagcatccgcaacgacatcgacaagctgatcgaggccctggagagcgacaagatcgtgatcggcatgatcgcccccgccgtgcgcgccgccatccaggaggagttcggcatcgacgaggacgtggccatggccgagaagctggtgagcttcctgaagaccatcggcttcgacaaggtgttcgacgtgagcttcggcgccgacctggtggcctacgaggaggcccacgagttctacgagcgcctgaagaagggcgagcgcctgccccagttcaccagctgctgccccgcctgggtgaagcacgccgagcacacctacccccagtacctgcagaacctgagcagcgtgaagagcccccagcaggccctgggcaccgtgatcaagaagatctacgcccgcaagctgggcgtgcccgaggagaagatcttcctggtgagcttcatgccctgcaccgccaagaagttcgaggccgagcgcgaggagcacgagggcatcgtggacatcgtgctgaccacccgcgagctggcccagctgatcaagatgagccgcatcgacatcaaccgcgtggagccccagcccttcgaccgcccctacggcgtgagcagccaggccggcctgggcttcggcaaggccggcggcgtgttcagctgcgtgctgagcgtgctgaacgaggagatcggcatcgagaaggtggacgtgaagagccccgaggacggcatccgcgtggccgaggtgaccctgaaggacggcaccagcttcaagggcgccgtgatctacggcctgggcaaggtgaagaagttcctggaggagcgcaaggacgtggagatcatcgaggtgatggcctgcaactacggctgcgtgggcggcggcggccagccctaccccaacgacagccgcatccgcgagcaccgcgccaaggtgctgcgcgacaccatgggcatcaagagcctgctgacccccgtggagaacctgttcctgatgaagctgtacgaggaggacctgaaggacgagcacacccgccacgagatcctgcacaccacctaccgcccccgccgccgctaccccgagaaggacgtggagatcctgcccgtgcccaacggcgagaagcgcaccgtgaaggtgtgcctgggcaccagctgctacaccaagggcagctacgagatcctgaagaagctggtggactacgtgaaggagaacgacatggagggcaagatcgaggtgctgggcaccttctgcgtggagaactgcggcgccagccccaacgtgatcgtggacgacaagatcatcggcggcgccaccttcgagaaggtgctggaggagctgagcaagaacggctaa

SEQ ID NO: 213 - DNA, 3621 bp, Nyctotherus ovalis
atgatcagccgcctgatcgccaagaaggcccccctgttcctgcgcaccttcgccaccagcgagatgatcagcctgaagatcgacggcaagatcatcagcgtgcccaagggcatcatgctggccgacgccatcaagaaggccggcgccaacgtgcccaccatgtgctaccaccccgacctgcccaccagcggcggcatctgccgcgtgtgcctggtggagagcgccaagagccccggctaccccatcatcagctgccgcacccccgtggaggagggcatggagatcgtgacccagggcagcaagatgaaggagtaccgccaggccaacctggccctgatgctgagccgccaccccaacgcctgcctgagctgcaccagcaacaccaactgcaagacccaggagctgagcgccaacatgaacatcggccagtgcggcttcgccaacgccaccccccccaagaacgacgacagctacgacatgaccaccgccatcgagcgcgacaacgacaagtgcatcaactgcgacatctgcgtgcacacctgcagcctgcagggcctgaacgccctgggcttctacaacgaggagggccacgccgtgaagagcatgggcaccctggacgtgagcgagtgcatccagtgcggccagtgcatcaaccgctgccccaccggcgccatcaccgagaagagcgagatccgccccgtgctggacgccatcaacatccagcagcgcctggtgttccagatggcccccagcatccgcgtggccgtggccgaggagttcggcatcaagcccggcgagaagatcctgaagaacgagatcgccaccgccctgcgcaagctgggcagcaacgtgttcgtgctggacaccaacttcagcgccgacctgaccatcatcgaggagggccacgagctgatcgagcgcctgtaccgcaacgtgaccggcaagaagctgctgggcggcgaccacatgcccatcgacctgcccatgctgaccagctgctgccccggctggatcatgttcatcgagaagaactaccccgacctgctgaacaacctgagcacctgcaagagcccccagggcatgctgggcgccctgatcaagggctactgggccaagaacatcaagaagatggaccccaaggacatcgtgagcgtgagcatcatgccctgcaccgccaagaaggccgagaaggagcgcccccagctgcgcggcgacgagggctacaaggacgtggactacatcctgaccacccgcgagctggccaagatgctgaagcagagcaacatcgacctggccaagatggagcccacccccttcgacaaggtgatgagcgagggcaccggcgccgccgtgatcttcggcgtgaccggcggcgtgatggaggccgccctgcgcaccgccaacgaggtgatcaccggccgcgaggtgcccttcaagaacctgaacatcgaggccgtgcgcggcatggagggcatccgcgaggccggcatcaagctggagaacgtgctggacaagtacaaggccttcgagggcgtgaccgtgaaggtggccatcgcccacggccccaacaacgcccgcaaggtgatggacatcatcaagcaggccaaggagagcggcaagcccgccccctggcacttcgtggaggtgatggcctgccccggcggctgcatcggcggcggcggccagcccaagcccaccaacctggagatccgccaggcccgcacccagctgaccttcaaggaggacatggacctgcccctgcgcaagagccacgacaaccccgagatcaaggccatctacgagaactacctgaaggagcccctgggccacaacagccaccactacctgcacaccacctacagcagccagaaggtgcgcgacatgaacctgtacaacgccaacgaggccgccggcctggacgagatcctggccaagtaccccaaggagaaggagtacctgatgcccatcatcatcgaggagcacgacaagaagggctacatcagcgaccccagcatcgtgaagatcagcgagcacctgggcatgtaccccgcccagatcgagagcatcctgagcagctaccactacttcccccgcgagcacaccatcgccatcctgatgagcatctgcgtgcactgccacaactgcatgatgaagggccagggccgcctgctgaagaccatccaggagacctacgacatccacgagacccacggcggcgtggccaaggacggcagcttcaccctgcacaccctgaactggctgggctactgcgtgaacgacgcccccgccatgatgatcaagcgcaagggcaccaactacgtggagaccttcaccggcctgctgggcgacaacatcgaccagcgcctgaagagcctgaagaacctgaagaaggagctgcccaagtggcccaagaacaacatccgcgagatgaagagccagcgcaacggcaacagctacagctgcatgaacacccaggcccccatcgccgaggccaccaagaaggccgtgagcatgggccccgagaaggtgatcgaggaggtgttcaagagcaacctggtgggccgcggcggcgccggcttccgcaccggcaagaagtgggagagcgcctacaagacccccgccagcgacaagtacgtggtgtgcaacgccgacgagggcctgcccagcacctacaaggactggtgcctgctgaacaacgaggccaagcgcaaggaggtgttcaccggcatgggcatctgcgccaagaccatcggcgccaagcgctgcttcatgtacctgcgctacgagtaccgcaacctggtgcccgccctggagcagagcatcaaggacgtgcagagcacctgccccgagctggccgacctgaagtacgagatccgcctgggcggcggcccctacgtggccggcgaggagaacgcccagttcgagagcatcgagggccgcgcccccctgccccgcaaggaccgccccggcaacatcttccccaccatggagggcctgttccacaagcccaccgtgatcaacaacgtggagaccttcttcgccatcccccacatcatccagcagggcagccagagcttcggcgagggcaagatgcccaagctgctgagcgtgaccggcgacgtggacgagcccatcctgatcgagaccaacctgaacaactacagcctgaaccacctgctgcaggagatcagcgccaaggacatcgtggccgccgagatcggcggctgcaccgagcccatcatcttcggcagcaagttcgacaccctgttcggcttcggccgcggcaccctgaacgccgtgggcagcgtggtgctgttcaacagcagctgcgacctgggcaagatctacgagaacaagctgaagttcatggccgaggagagctgcaagcagtgcgtgccctgccgcgacggcagctacatcttccaccgcgccttcaaggagctgcgcgacaccggcaagagcagctacaacatgcgcgccctggccgtggccagcgagagcgccgcccgcagcagcatctgcgcccacggcaaggccctggagagcctgttcaagagcgcctgcgacttcatgaacaagaccaagcccatctactaaccccacagcacctaccaccagttc

SEQ ID NO: 214 - DNA, 1404 bp, Spironucleus barkhanus
atgaaggtgcgctaaagccccttcaagatcgacatcaccaacggccccatcgaccgcaacgacgccatctaaatcgactaccagaagtgcatcggctgctaaatgtgcgccaagacctgcaccgacagctaaaacttcaacatcttcaagatcagcgcccccaagaccaagcccttcgtgaacgcctacggcagcgtggccgagggcaccgagcgcaacgccctggccggcaccgactgcaccggctgcggcgcctgcgtgcgcgcctgccccgtggaggccctgatgcccgccttcaacatccgccccgtgctggagcccatcagcgagaagaagaaggtgaccatcgccgtgatcgcccccagcacccgcgtgggcctggccgagggcatgggcatgggcgtgggcgtgaccgccgagcgctaaatggtgtacgagctgaagtaaatgggcttcgactacgtgttcgacaacatgtggggcgccgacgcccccaccaccgaggacgccaaggagatcctgaaggccaaggccgccggcaagaccgccttcaccagctgctgccccgcctgggtgaagctggtggagaccacctaccccgagctgctgcccaacatcagcagcgcccgcagcccccacggcatcatctgcagcgtgatcaagaagtacttcgccaaggacatcggcaagaaggccgacgagctgtacgtggtgggcgtgatgccctgcaccgccaagaagaacgaggccgcccgcaaggagctgaccaccgacggcagccccgactgcgacatcagcatcaccacccgcgagctgatggcctacctgaaggagaagaaggtgaccttcagcgccgcccgcgagatcgagctgaaggacaacgtgtaagcctaatacgacgcccccttcaacaccttcagcggcagcgcctacatctacggcaagaccgccggcgtgaccgaggccgtggtgcgctacgtgtgcgccatcaagaaggtgcccttcagcgtgggcatgatcaccaaggagctgatctgggagaacaagctgcacagcagcagcctgaccctgctgaccttcagcgccgccggcgaggactaccgcatctgcgtgagctacggcggcctggccgcccacaaggccgtggagctgtacaagagcggcgagctgaaggtggacgccgtggaggtgatggtgtgccccggcggctgcgtgggcggcggcggccagcccaagtaacccaagaaggacatgatcctgaagcgccacgagggcctggacaagcacgacaaggaggccccctacagcaactgcaccgagaaccccaccctgaacgagttctacgagcgcatcggcaccgacgtgcaccacgtgatgcacaccacctacagcgcctacaagtaa

SEQ ID NO: 215 - DNA, 1407 bp, Trichomonas vaginalis
atgctggccagcagcgccaccgccatgaagggcttcgccaacagcctgcgcatgaaggactacagcagcaccggcatcaacttcgacatgaccaagtgcatcaactgccagagctgcgtgcgcgcctgcaccaacatcgccggccagaacgtgctgaagagcctgaccgtgaacggcaagagcgtggtgcagaccgtgaccggcaagcccctggccgagaccaactgcatcagctgcggccagtgcaccctgggctgccccaagttcaccatcttcgaggccgacgccatcaaccccgtgaaggaggtgctgaccaagaagaacggccgcatcgccgtgtgccagatcgcccccgccatccgcatcaacatggccgaggccctgggcgtgcccgccggcaccatcagcctgggcaaggtggtgaccgccctgaagcgcctgggcttcgactacgtgttcgacaccaacttcgccgccgacatgaccatcgtggaggaggccaccgagctggtgcagcgcctgagcgacaagaacgccgtgctgcccatgttcaccagctgctgccccgcctgggtgaactacgtggagaagagcgaccccagcctgatcccctacctgagcagctgccgcagccccatgagcatgctgagcagcgtgatcaagaacgtgttccccaagaagatcggcaccaccgccgacaagatctacaacgtggccatcatgccctgcacccgcaagaaggacgagatccagcgcagccagttcaccatgaaggacggcaagcaggagaccggcgccgtgctgaccagccgcgagctggccaagatgatcaaggaggccaagatcaacttcaaggagctgcccgacaccccctgcgacaacttctacagcgaggccagcggcggcggcgccatcttctgcgccaccggcggcgtgatggaggccgccgtgcgcagcgcctacaagttcctgaccaagaaggagctggcccccatcgacctgcaggacgtgcgcggcgtggccagcggcgtgaagctggccgaggtggacatcgccggcaccaaggtgaaggtggccgtggcccacggcatcaagaacgccatgaccctgatcaagaagatcaagagcggcgaggagcagttcaaggacgtgaagttcgtggaggtgatggcctgccccggcggctgcgtggtgggcggcggcagccccaaggccaagaccaagaaggccgtgcaggcccgcctgaacgccacctacagcatcgacaagagcagcaagcaccgcaccagccaggacaacccccagctgctgcagctgtacaaggagagcttcgagggcaagttcggcggccacgtggcccaccacctgctgcacacccactacaagaaccgcaaggtgaacccctaa

SEQ ID NO: 216 - DNA, 1350 bp, Trichomonas vaginalis
atgctggccagcagcagccgcgccgccgccaacatccgctgggtggacaccagccacaacgccatcgccttcgacatgcacaagtgcatcaactgccaggcctgcgtgcgcgcctgcaagaacgtggccggccagagcgtgctgaagagcgtgaagatcaacgagggcaagaagaagggcgtggtgcagaccgtgaccggcaagctgctggccgagaccaactgcatcggctgcggccagtgcaccctggtgtgccccacccaggccatccacgagaaggacgccctgaagcagatgaacaacatcttcaagaacaagggcgaccgcatcctggtgtgccagatcgcccccgccatccgcatcaacatgcgccgcccctggtgcagcagccgcaacagcttccaccgccagagccgctacagcccccagcgcctgggcttcgactacgtgttcgacaccaacttcggcgccgacctgaccatcgtggaggaggccaccgagctgctgcagcgcctgaacgaccccaaggccgtgctgcccatgttcaccagctgctgccccgcctgggtgaactacgtggagaagagctacccccagtggatgccccacctgagcacctgccgcagccccatcggcatgctgagcgccgtgatcaagaacgtgttccccaagcacatcggcgtggaccccaagcgcatcttcagcgtgggcatcatgccctgcaccgccaagaaggacgaggccgcccgcgagcagctgatgaccaagagcggcctgcacgagaccgacctggacatcaccagccgcgagctggccaagatgatcaaggccgccaagatcaacttcaaggagctgcccgacaccgagctggacagcccctacgccatggccaccggcggcggcgccatcttctgcgccaccggcggcgtgatggaggccgccgtgcgcagcgcctacaagttcgccaccggcaaggagctggcccccatcgagttcgtgcaggtgcgcggcgccgagaagggcatcaaggtgggcaccgtggacatcaacggccgcgagatcaaggtggccgtggcccagggcgtgaagaacgccatgagcctgatcaagaagatcgaggagggccaggacgacgtgaagggcgtggtgttctgcgaggtgatggcctgccccggcggctgcgtgggcggcggcggcagcccccgcgccaagaccaaggccgccatgaacaagcgcctggacgccacctaccgcatcgaccgcgccagcaagtaccgcaccccccaggacaacacccagctgcaggacctgtacaacgccacctgggtggtgagcctggtgatggactaa

SEQ ID NO: 217 - DNA, 1770 bp, Trichomonas vaginalis
gccagcaccggcatcaacagcaccgccaacatcctgcgcaacatcaccgtgaccgtgaacggcaagcccctggaggccaagaagggcgagaccgtgctggagctgtgcgaccgcaacaacatccgcatcccccgcctgtgcttccaccccaacctgccccccaaggccagctgccgcgtgtgcctggtggagtgcgacggcaagtggctgagccccgcctgcgtgaccaccgtgtgggacggcctgaagatcgacaccaagagcaagaacgtgcgcgacagcgtggagaacaacctgaaggagctgctggactgccacgacgagacctgcagcgcctgcatcgccaaccaccgctgccagttccgcgacatgaacgtggcctacagcgtgaaggccgagaccaaggagatctgcagcgaggagggcatcgacgagagcaccaacgccatccgcctggacaccagcaagtgcgtgctgtgcggccgctgcatccgcgcctgcgaggaggtggccggcaccagcgccatcatcttcggcaaccgcgccaagaagatgcgcatccagcccaccttcggcgtgaccctgcaggagaccagctgcatcaagtgcggccagtgcaccctgtactgccccgtgggcgccatcaccgagaagagccaggtgaaggaggccctggacatcctggccaacaagggcaagaagatcaccgtggtgcaggtggcccccgccgtgcgcgtggccctgagcgaggccttcggctacaaggagggcaccgtgaccaccggcaagatggtgagcgccctgaaggccctgggcttcgacctggtgtacgacaccaactacggcgccgacctgaccatctgcgaggaggccggcgagctggtgaaccgcctgcgcgaccccaacgccaagttccccatgttcaccacctgctgccccgcctgggtgaactacgtggagcagagcgcccccgacttcatccccaacctgagcagctgccgcagcccccagggcatgctgagcgccctgatcaagaactacctgcccaagctgctggacgtgaagcaggaggacgtgctgaacttcagcatcatgccctgcaccgccaagaaggacgaggtggagcgccccgagctgcgcaccaagagcggcctgaaggagaccgacatggtgctgaccgtgcgcgagctggtggagatgatcaagctgagcaacatcgacttcaacaacctgcccgacacccagttcgacaacatcttcggcttcggcagcggcgccggccagatcttcgccgccaccggcggcgtgatggaggccgccagccgcaccgccttcgaggtgtacaccggcaagaagctgaccaacgtgaacatctaccccgtgcgcggcatggacggcctgcgcatcgccgagctggacctggacggcaccaagctgaaggtggccgtgtgccacggcatcgccaacaccgccaagctgctggaccgcctgcgcgagaaggaccccgagctgatggacatcaagttcatcgagatcatggcctgccccggcggctgcgtgtgcggcggcggcaccccccagcccaagaaccgcgtgagcctggacaaccgcctggccgccatctacaacatcgacgccaagatggagtgccgcaagagccacgagaaccccctgatcaagggcgtgtacaaggagttcctgggcaagcccaacagccacctggcccacgagctgctgcacacccacttcaagcaccaccccaagtggtaa

SEQ ID NO: 218 - DNA, 1749 bp, Trichomonas vaginalis
atgaagaccatcatcctgaacggcaacgaggtgcacaccgacaaggacatcaccatcctggagctggcccgcgagaacaacgtggacatccccaccctgtgcttcctgaaggactgcggcaacttcggcaagtgcggcgtgtgcatggtggaggtggagggcaagggcttccgcgccgcctgcgtggccaaggtggaggacggcatggtgatcaacaccgagagcgacgaggtgaaggagcgcatcaagaagcgcgtgagcatgctgctggacaagcacgagttcaagtgcggccagtgcagccgccgcgagaactgcgagttcctgaagctggtgatcaagaccaaggccaaggccagcaagcccttcctgcccgaggacaaggacgccctggtggacaaccgcagcaaggccatcgtgatcgaccgcagcaagtgcgtgctgtgcggccgctgcgtggccgcctgcaagcagcacaccagcacctgcagcatccagttcatcaagaaggacggccagcgcgccgtgggcaccgtggacgacgtgtgcctggacgacagcacctgcctgctgtgcggccagtgcgtgatcgcctgccccgtggccgccctgaaggagaagagccacatcgagaaggtgcaggaggccctgaacgaccccaagaagcacgtgatcgtggccatggcccccagcgtgcgcaccgccatgggcgagctgttcaagatgggctacggcaaggacgtgaccggcaagctgtacaccgccctgcgcatgctgggcttcgacaaggtgttcgacatcaacttcggcgccgacatgaccatcatggaggaggccaccgagctgctgggccgcgtgaagaacaacggccccttccccatgttcaccagctgctgccccgcctgggtgcgcctggcccagaactaccaccccgagctgctggacaacctgagcagcgccaagagcccccagcagatcttcggcaccgccagcaagacctactaccccagcatcagcggcatcgcccccgaggacgtgtacaccgtgaccatcatgccctgcaacgacaagaagtacgaggccgacatccccttcatggagaccaacagcctgcgcgacatcgacgccagcctgaccacccgcgagctggccaagatgatcaaggacgccaagatcaagttcgccgacctggaggacggcgaggtggaccccgccatgggcacctacagcggcgccggcgccatcttcggcgccaccggcggcgtgatggaggccgccatccgcagcgccaaggacttcgccgagaacaaggagctggagaacgtggactacaccgaggtgcgcggcttcaagggcatcaaggaggccgaggtggagatcgccggcaacaagctgaacgtggccgtgatcaacggcgccagcaacttcttcgagttcatgaagagcggcaagatgaacgagaagcagtaccacttcatcgaggtgatggcctgccccggcggctgcatcaacggcggcggccagccccacgtgaacgccctggaccgcgagaacgtggactaccgcaagctgcgcgccagcgtgctgtacaaccaggacaagaacgtgctgagcaagcgcaagagccacgacaaccccgccatcatcaagatgtacgacagctacttcggcaagcccggcgagggcctggcccacaagctgctgcacgtgaagtacaccaaggacaagaacgtgagcaagcacgagtaa

SEQ ID NO: 219 - DNA, 1494 bp, Chlamydomonas reinhardtii
atgagcgccctggtgctgaagccctgcgccgccgtgagcatccgcggcagcagctgccgcgcccgccaggtggccccccgcgcccccctggccgccagcaccgtgcgcgtggccctggccaccctggaggcccccgcccgccgcctgggcaacgtggcctgcgccgccgccgcccccgccgccgaggcccccctgagccacgtgcagcaggccctggccgagctggccaagcccaaggacgaccccacccgcaagcacgtgtgcgtgcaggtggcccccgccgtgcgcgtggccatcgccgagaccctgggcctggcccccggcgccaccacccccaagcagctggccgagggcctgcgccgcctgggcttcgacgaggtgttcgacaccctgttcggcgccgacctgaccatcatggaggagggcagcgagctgctgcaccgcctgaccgagcacctggaggcccacccccacagcgacgagcccctgcccatgttcaccagctgctgccccggctggatcgccatgctggagaagagctaccccgacctgatcccctacgtgagcagctgcaagagcccccagatgatgctggccgccatggtgaagagctacctggccgagaagaagggcatcgcccccaaggacatggtgatggtgagcatcatgccctgcacccgcaagcagagcgaggccgaccgcgactggttctgcgtggacgccgaccccaccctgcgccagctggaccacgtgatcaccaccgtggagctgggcaacatcttcaaggagcgcggcatcaacctggccgagctgcccgagggcgagtgggacaaccccatgggcgtgggcagcggcgccggcgtgctgttcggcaccaccggcggcgtgatggaggccgccctgcgcaccgcctacgagctgttcaccggcacccccctgccccgcctgagcctgagcgaggtgcgcggcatggacggcatcaaggagaccaacatcaccatggtgcccgcccccggcagcaagttcgaggagctgctgaagcaccgcgccgccgcccgcgccgaggccgccgcccacggcacccccggccccctggcctgggacggcggcgccggcttcaccagcgaggacggccgcggcggcatcaccctgcgcgtggccgtggccaacggcctgggcaacgccaagaagctgatcaccaagatgcaggccggcgaggccaagtacgacttcgtggagatcatggcctgccccgccggctgcgtgggcggcggcggccagccccgcagcaccgacaaggccatcacccagaagcgccaggccgccctgtacaacctggacgagaagagcaccctgcgccgcagccacgagaaccccagcatccgcgagctgtacgacacctacctgggcgagcccctgggccacaaggcccacgagctgctgcacacccactacgtggccggcggcgtggaggagaaggacgagaagaagtaa

SEQ ID NO: 220 - DNA, 1248 bp, Chlorella fusca
gccggccccaccagcgagtgcgactgcccccccaccccccaggccaagctgccccactggcagcaggccctggacgagctggccaagcccaaggagagccgccgcctgatgatcgcccagatcgccagcgccgtgcgcgtggccatcgccgagaccatcggcctggcccccggcgacgtgaccatcggccagctggtgaccggcctgcgcatgctgggcttcgactacgtgttcgacaccctgttcggcgccgacctgaccatcatggaggagggcaccgagctgctgcaccgcctgcaggaccacctggagcagcaccccaacaaggaggagcccctgcccatgttcaccagctgctgccccggctgggtggccatggtggagaagagcaaccccgagctgatcccctacctgagcagctgcaagagcccccagatgatgctgggcgccgtgatcaagaactactacgcccagcaggtgggcgtgcagcccagcgacatctgcaacgtgagcgtgatgccctgcgtgcgcaagcagggcgaggccgaccgcgagtggttcaacaccaccggcgccggcctggcccgcgacgtggaccacgtggtgaccaccgccgaggtgggcaagatcttcctggagcgcggcatcaagctgaacgagctgcccgagagcaacttcgacaaccccatcggcgagggcaccggcggcgccctgctgttcggcaccaccggcggcgtgatggaggccgccctgcgcaccgtgtacgaggtggtgacccagaagcccatgggccgcgtggacttcgaggaggtgcgcggcctggagggcatcaaggaggccgagatcaccctgaagcccggcgacgacagccccttcaaggccttcgccggcgccgacggccagggcatcaccctgaagatcgccgtggccaacggcctgggcaacgccaagaagctgatcaagagcctgagcgagggcaaggccaagtacgacttcatcgaggtgatggcctgccccggcggctgcatcggcggcggcggccagccccgcagcaccgacaagcagatcctgcagaagcgccagcaggccatgtacaacctggacgagcgcagcaccatccgccgcagccacgacaaccccttcatccaggccctgtacgacaagttcctgggcgcccccaacagccacaaggcccacgacctgctgcacacccactacgtggccggcggcatccccgaggagaagtaa

SEQ ID NO: 221 - DNA, 1518 bp, Chlamydomonas reinhardtii
atggccctgggcctgctggccgagctgcgcgccggccaggccgtggcctgcgcccgccgcaccaacgcccccgcccaccccgccgccgtggtgccctgcctgcccagccgcgccggcaagttcttcaacctgagccagaaggtgcccagcagccagagcgcccgcggcagcaccatccgcgtggccgccaccgccaccgacgccgtgccccactggaagctggccctggaggagctggacaagcccaaggacggcggccgcaaggtgctgatcgcccaggtggcccccgccgtgcgcgtggccatcgccgagagcttcggcctggcccccggcgccgtgagccccggcaagctggccaccggcctgcgcgccctgggcttcgaccaggtgttcgacaccctgttcgccgccgacctgaccatcatggaggagggcaccgagctgctgcaccgcctgaaggagcacctggaggcccacccccacagcgacgagcccctgcccatgttcaccagctgctgccccggctgggtggccatgatggagaagagctaccccgagctgatccccttcgtgagcagctgcaagagcccccagatgatgatgggcgccatggtgaagacctacctgagcgagaagcagggcatccccgccaaggacatcgtgatggtgagcgtgatgccctgcgtgcgcaagcagggcgaggccgaccgcgagtggttctgcgtgagcgagcccggcgtgcgcgacgtggaccacgtgatcaccaccgccgagctgggcaacatcttcaaggagcgcggcatcaacctgcccgagctgcccgacagcgactgggaccagcccctgggcctgggcagcggcgccggcgtgctgttcggcaccaccggcggcgtgatggaggccgccctgcgcaccgcctacgagatcgtgaccaaggagcccctgccccgcctgaacctgagcgaggtgcgcggcctggacggcatcaaggaggccagcgtgaccctggtgcccgcccccggcagcaagttcgccgagctggtggccgagcgcctggcccacaaggtggaggaggccgccgccgccgaggccgccgccgccgtggagggcgccgtgaagccccccatcgcctacgacggcggccagggcttcagcaccgacgacggcaagggcggcctgaagctgcgcgtggccgtggccaacggcctgggcaacgccaagaagctgatcggcaagatggtgagcggcgaggccaagtacgacttcgtggagatcatggcctgccccgccggctgcgtgggcggcggcggccagccccgcagcaccgacaagcagatcacccagaagcgccaggccgccctgtacgacctggacgagcgcaacaccctgcgccgcagccacgagaacgaggccgtgaaccagctgtacaaggagttcctgggcgagcccctgagccaccgcgcccacgagctgctgcacacccactacgtgcccggcggcgccgaggccgacgcctaa

SEQ ID NO: 222 - DNA, 1212 bp, Scenedesmus obliquus
ccccactggcagcagaccctggacgagctggccaagcccaaggagcgcaaggtgatgatcgcccagatcgcccccgccgtgcgcggcatcgccgagaccatgggcctgaaccccggcgacgtgaccgtgggccagatggtgaccggcctgcgcatgctgggcttcgactacgtgttcgacaccctgttcggcgccgacctgaccatcatggaggagggcaccgagctgctgcaccgcctgcaggaccacctggagcagcaccccaacaaggaggagcccctgcccatgttcaccagctgctgccccggctgggtggccatggtggagaagagcaaccccgagctgatcccctacctgagcagctgcaagagcccccagatgatgctgggcgccgtgatcaagaactacttcgccgccgaggccggcgccaagcccgaggacatctgcaacgtgagcgtgatgccctgcgtgcgcaagagcggcgaggccgagccccgcagcggcagcacccaccaccgcgccggccgccgcgacgtggaccacgtgatgaccaccgccgagctgggcaagatcttcgtggagcgcggcatcaagctgaacgagctgcaggagagccccttcgacaaccccgtgggcgagggcagcggcggcggcctgctgttcggcaccaccggcggcgtgatggaggccgccctgcgcaccgtgtacgaggtggtgaccgccgaggccctgggcccccagcgcagcagcctgaccaccagcaccgcctggacccccgcccagcgcgccagcccccgccccagcccccaggcccccaccgcccccagccgccccctgcaggcccagaccgagagcggcatcaccctgaacatcgccgtggccaacggcctgggcaacgccaagaagctgatcaagcagctggccgccggcgagagcaagtacgacttcaccgaggtgatggcctgccccggcggctgcatcggcggcggcggccagccccagcgcaacaagcagatcctgcagaagcgccaggccgccatgtacgacctggacgagcgcgccgtgatccgccgcaccgagaaccccctgatcggcgccctgtacgagaagttcctgggcgagcccaacggccacaaggcccacgagctgctgcacacccactacgtggccggcggcgtgcccgaccgccgcagcgagggcgaggcctggtaa

SEQ ID NO: 223 - DNA, 1746 bp, Thermoanaerobacter tengcongensis strain MB4T
atggacaaggtgcgcgtgaccatcgacggcatcaccgtggaggtgcccagctactacaccgtgctggaggccgccaaggaggccggcatcgacatccccaccctgtgctacctgaaggagatcaaccagatcggcgcctgccgcatctgcctggtggagatcgagggcgtgcgcaacctgcagaccagctgcacctaccccgtgttcgacggcatgaaggtgtacaccaacacccccaagatccgcgaggcccgccgcctgaacctggagctgatcctgagcaaccacgaccgcaactgcctgacctgcgtgcgcagcaccaactgcgagctgcaggccctggccaagcgcctgggcgtggaggagatccgcttcgagggcgagaacatcaagtaccccatcgacgacgccagccccgccgtggtgcgcgaccccaacaagtgcgtgctgtgccgccgctgcgtggccgtgtgcagcgaggtgcagaacgtgttcgccatcggcatggtgaaccgcggcttcaagaccatggtggcccccagcttcggccgcagcctgaaggacagcccctgcatcagctgcggccagtgcatcatggtgtgccccgtgggcgccatctacgagaaggaccacaccaagcgcgtgtacgaggccctggccgacgacaagaagtacgtggtggcccagaccgcccccgccgtgcgcgtggccctgggcgaggagttcggcatgcccgtgggcaccatcgtgaccggcaagatggccgccgccctgcgccgcatgggcttcgacgccgtgttcgacaccaacttcgccgccgacctgaccatcatggaggagggcagcgagctgctggagcgcatcaagcacggcggcaagctgcccatgatcaccagctgcagccccggctggatcgccttctgcgagaagtactaccccgagttcatcgacaacctgagcacctgcaagagcccccacatgatgatgggcgccctggtgaagagctactacgccgagaagaagggcctggaccccaaggacatcttcgtggtgagcatcatgccctgcaccgccaagaagctggagatcgagcgcgaggagatgatccgcaacggcatgaaggacgtggacgccgtgctgaccacccgcgagctggcccgcatgatcaaggagatgggcatcgacttcgtgaacctgaaggacgaggagttcgacgagcccctgggcatgagcaccggcgccggcgccatcttcggcgccaccggcggcgtgatggaggccgccctgcgcaccgtggccgagatcgtggagggccgcgacatcggcaagatcgacttcgaggaggtgcgcggcctggagggcgtgcgcgaggccaccatcaccatcgacggcatggacatcaagatcgccatcgccaacggcaccggcaacgccaagaagctgctggacaaggtgaaggccggcgaggtggagtaccacttcatcgaggtgatgggctgccccggcggctgcatcatgggcggcggccagcccatccacaaccccaacgagatggaggaggtgaagaagctgcgcgccaaggccatctacgagatcgacaagaacctgcccatccgcaagagccacgagaaccccgccatcaagcgcctgtacgaggagttcctgggctaccccctgagcgagaagagccacgagctgctgcacacccactacagccgcaaggagctgtaccccctggtgaagtaa

SEQ ID NO: 224 - DNA, 1821 bp, Clostridium thermocellum
atggccttcgtgtggcgcaacgtgcgcagccgccccttccccaagaagcccaacggccgcggctgcgagaagatgcagatggtgaacgtgaccatcgacaactgcaagatccaggtgcccgccaactacaccgtgctggaggccgccaagcaggccaacatcgacatccccaccctgtgcttcctgaaggacatcaacgaggtgggcgcctgccgcatgtgcgtggtggaggtgaagggcgcccgcagcctgcaggccgcctgcgtgtaccccgtgagcgagggcctggaggtgtacacccagacccccgccgtgcgcgaggcccgcaaggtgaccctggagctgatcctgagcaaccacgagaagaagtgcctgacctgcgtgcgcagcgagaactgcgagctgcagcgcctggccaaggacctgaacgtgaaggacatccgcttcgagggcgagatgagcaacctgcccatcgacgacctgagccccagcgtggtgcgcgaccccaacaagtgcgtgctgtgccgccgctgcgtgagcatgtgcaagaacgtgcagaccgtgggcgccatcgacgtgaccgagcgcggcttccgcaccaccgtgagcaccgccttcaacaagcccctgagcgaggtgccctgcgtgaactgcggccagtgcatcaacgtgtgccccgtgggcgccctgcgcgagaaggacgacatcgacaaggtgtgggaggccctggccaaccccgagctgcacgtggtggtgcagaccgcccccgccgtgcgcgtggccctgggcgaggagttcggcatgcccatcggcagccgcgtgaccggcaagatggtggccgccctgagccgcctgggcttcaagaaggtgttcgacaccgacaccgccgccgacctgaccatcatggaggagggcaccgagctgatcaaccgcatcaagaacggcggcaagctgcccctgatcaccagctgcagccccggctggatcaagttctgcgagcacaactaccccgagttcctggacaacctgagcagctgcaagagcccccacgagatgttcggcgccgtgctgaagagctactacgcccagaagaacggcatcgaccccagcaaggtgttcgtggtgagcatcatgccctgcaccgccaagaagttcgaggcccagcgccccgagctgagcagcaccggctaccccgacgtggacgtggtgctgaccacccgcgagctggcccgcatgatcaaggagaccggcatcgacttcaacagcctgcccgacaagcagttcgacgaccccatgggcgaggccagcggcgccggcgtgatcttcggcgccaccggcggcgtgatggaggccgccatccgcaccgtgggcgagctgctgagcggcaagcccgccgacaagatcgagtacaccgaggtgcgcggcctggacggcatcaaggaggccagcatcgagctggacggcttcaccctgaaggccgccgtggcccacggcctgggcaacgcccgcaagctgctggacaagatcaaggccggcgaggccgactaccacttcatcgagatcatggcctgccccggcggctgcatcaacggcggcggccagcccatccagcccagcagcgtgcgcaactggaaggacatccgctgcgagcgcgccaaggccatctacgaggaggacgagagcctgcccatccgcaagagccacgagaaccccaagatcaagatgctgtacgaggagttcttcggcgagcccggcagccacaaggcccacgagctgctgcacacccactacgagaagcgcgagaactaccccgtgaagtaa

SEQ ID NO: 225 - DNA, 1911 bp, Neocallimastix frontalis
atgagcatgctgagcagcgtgctgaacaaggccgtggtgaaccccaagctgacccgcagcctggccaccgccgccgccgagaagatggtgaacatcagcatcaacggccgcaagttccaggtgaagcccaagaccaccgtgctggaggccgccaaggccaacggctactacatccccaccctgtgctaccaccaggagctgcccgtggccggcaactgccgcctgtgcctggtgtacgccaagggcagctggaagcccctgaccgcctgcaccaccgaggtgtgggagggcatggagatcgagaccgacagccccgccgtgatcgagaccgtgcgcagcagcctgagcatgatgcgcgaggagcaccccaacgactgcatgacctgcggcagcaacggcgactgcgagttccaggacctgatctaccgctaccagatcgacgccaagcaccccgtgcgcagcctgctgaagcacaagagcaagaagaccaaccacagcatcaccgagccctgctacagccccttcgacaacaccaccttcagcgtggcccgcgacatgaacaagtgcgtgaagtgcggccgctgcatccgcgcctgccaccacttccagaacatcaacatcctgggcttcatcaaccgcgccggctacgagcgcgtgggcacccccatggaccgccccatgaacttcaccaagtgcgtggagtgcggccagtgcagccaggtgtgccccgtgggcgccatcaccgcccgcaccgaggtggtggacgtgctgcgccacctggacaccaagcgcaaggtggtggtgtgcagcaccgcccccgccatccgcgtggcccccgccgaggagttcagcaccgaggccgacttcgacttcaccggcaagatggtggccggcctgcgcaagctgggcttcgactacatcttcgacaccaacttcagcgccgacctgaccatcatggaggagggcaccgagctgatcgaccgcctgaacaacggcggcaagttccccatgttcaccagctgctgccccggctggatcaacatggtggagaagagctaccccgagctgagcgacaacctgagcagctgcaagagcccccagcagatgatcggcgccgtgatcaagagctacttcgccaagaagctgggcctgagcaccgaggacatcatccacgtgagcatcatgccctgcaccgccaagaagggcgaggcccgccgccccgagttcgtgcagaagggcaaggacggcaaggactaccccgacatcgactacgtgatcaccacccgcgagctgctgaccctgctgaagctgaagaagatcaaccccgccgagctgcccgacgacaagttcgacagccccctgggcatcggcagcagcgccggcaacctgttcggcgtgaccggcggcgtgatggaggccgccatccgcaccgcccaggtgatcaccggcgtggagaaccccatccccctgggcgagctgaaggccatccgcggcctggacggcatcaaggccgccaacgtgcccctgaagaccaaggacggcaaggaggtgagcgtgcgcgccgccgtggtgagcggcggcgccaacatccagaagttcctggagaagatcaagaacaaggagctggagttcgacttcatcgagatgatgatgtgccccggcggctgcatcaacggcggcggccagcccaagagcgccgaccccgagatcgtggccaagaagatgcagcgcatgtacaccatggacgaccaggccaagctgcgcctgtgccacgagaaccccgagatcatcgacgtgtacaagaacttcctgggcgagcccaacagccacctggcccacgagctgctgcacacccactacaacgaccgcagcaagaccatccacgacatgggccaccacgagaagaagtaa

SEQ ID NO: 226 - DNA, 1668 bp, Piromyces sp. E2
tgcctggtggacgtgaagggcagctggaagcccctgaccgcctgcaccaccgaggtgtgggagggcatggagatcgagaccgacacccccgccgtgcgcgagaccgtgcgcagcagcctggccatgatgcgcgaggagcaccccaacgactgcatgacctgcgagagcaacggcaactgcgagttccaggacctgatctaccgctaccagatcgacgcccagcaccccgtgcgcaccctgctgcgcaacaagttcaagaagaccaaccacagcatcaccgagccctgctacagccccttcgacgacagcaccttcagcatcagccgcgacatgaacaagtgcgtgaagtgcggccgctgcgtgcgcgcctgccaccacttccagaacatcaacatcctgggcttcatcaaccgcgccggctacgagcgcgtgggcacccccatggaccgccccatgaacttcaccaagtgcgtggagtgcggccagtgcagccaggtgtgccccgtgggcgccatcaccgagcgcaacgagtgcatcgaggtgctgcgccacctggacaccaagcgcaagatcgtggtggtgagcaccgcccccgccatccgcgtggccctggccgaggagttcaacgccgagcccgacttcgacttcaccggcaagatggtggccggcctgaagaagctgggcttcgactacatcttcgacaccaacttcagcgccgacctgaccatcatggaggagggcaccgagctgatcacccgcctgaacgagggcggcaagttccccatgttcaccagctgctgccccggctggatcaacatggtggagaagagctaccccgagatccgcgacaacctgagcagctgcaagagcccccagcagatgatcggcgccgtgatcaagacctacttcgccaagaagatcaacgccaagcccgaggacatcatccacgtgagcgtgatgccctgcaccgccaagaagggcgaggccaagcgccccgagttcaagcgcgacggcgtgcccgacatcgaccacgtgatcaccacccgcgagctgatcaccctgctgaagctgaagcgcatcaaccccagcgagctgaagaacgagaagttcgacagccccctgggcatcggcagcagcgccggcaacctgttcggcgtgaccggcggcgtgatggaggccgccgtgcgcaccgcccagatcatcaccggcgtggagaaccccatccccctgggcgagctgaaggccatccgcggcctggacggcatcaaggccgccagcgtgcccctgaagaccaaggacggcaaggacgtgaacgtgcgcgccgccgtggtgagcggcggcgccaacatccagaagttcctggagaagctgaagaagaaggagctggagttcgacttcgtggagatgatgatgtgccccggcggctgcatcaacggcggcggccagcccaagagcgccgaccccaaggtggtggccaagaagatggagcgcatgtacaccatggacgaccaggccagcctgcgcctgagccacgagaaccccgagatcacccagatctacaaggagttcctgaaggagcccaacggccacctgagccacgagctgctgcacacccactacaacgaccgcagcaaggccatccaggacatgagcctgcaccagaagtaa

SEQ ID NO: 227 - DNA, 1170 bp, Neocallimastix frontalis
accgagcgcaacgaggtgatcgaggtgctgcgccagctggacagcaagcgcaagatcctggtgtgcagcaccgcccccgccatccgcgtggccctggccgaggagttcaacgccgaccccgacttcaacttcaccggcaagatggtggccggcctgcgcaagctgggcttcgactacatcttcgacaccaacttcagcgccgacctgaccatcatggaggagggcaccgagctgatcaaccgcctgaacaacggcggcaagttccccatgttcaccagctgctgccccggctggatcaacatggtggagaagagctaccccgagctgcgcgagaacctgagcacctgcaagagcccccagcagatgatcggcgccctgatcaagagctacttcgccaagaagctgggcgtgagcaccgaggacatcatccacgtgagcgtgatgccctgcaccgccaagaagggcgaggccaagcgccccgagttcgtgcagaagggcaaggacggcaagaactaccccgacatcgactacgtgctgaccacccgcgagctgctgaccctgatgaagctgaagaaggtgaaccccgccgagctggccgacgacaagctggacagccccctgggcatcagcagcagcgccggcaacctgttcggcgtgaccggcggcgtgatggaggccgccgtgcgcaccgcccagatcatcaccggcgtggagaaccccatccccctgggcgagctgaaggccgtgcgcggcctggagggcatcaaggccgccaccgtgcccctgaagaccaaggagggcaaggacatcaacgtgcgcgccgccgtggtgagcggcggcgccaacatccagaagttcctggagaagatcaagaacaaggaggtggagttcgacttcgtggagatgatgatgtgccccggcggctgcatcaacggcggcggccagcccaagagcgccgaccccaagatcgtgaccaagaagatgcagcgcatgtacaccatggacgagcaggccaccctgcgcctgagccacgagaacgaggaggtgaagcagatctacaaggagttcctgatcgagcccaacggccacctgagccacgagctgctgcacacccactacaacgaccgcagcaaggccatccaggacatgagcctgcacgagaagaagtaa

SEQ ID NO: 228 - DNA, 1377 bp, Desulfovibrio desulfuricans
atgaacggccagcagaacgtgatccgcatcgacagcgacatctgcaccggctgcggccgctgcaaggacgtgtgccccgtgggcgccgtggagggcgtgcagggcaccccccacagcatccgcgaggacgtgtgcgtgctgtgcggccagtgcgtgcagcagtgcagcgccttcgccagcttctacgagcagcaccccgcctgcatcgccgagaagaagcgcgagcgcggcctgttcgtgagcgaggccgcccccctgttcgccgcctggcacaccggcgacgccccccgcgtggccggccgcctggccgagggctgccacagcatggtgcagtgcgcccccgccgtgcgcgccgccatcggcgaggagttcggcatgcccgccggcgccctgacccccggccgcctggccgccgccctgcgccgcctgggcttcgaccgcgtgtacgacaccaacttcgccgccgacctgaccatcatggaggagggcagcgagctgctgcagcgcatggagggcgccggccccctgcccatgttcaccagctgctgccccgcctgggtgcgctacgccgagcagcagttccccgacctgctggagcacctgagcagctgcaagagcccccagcagatggccggcgccgtgttcaagagctacggcgcccagctggacggcgtggacccccgccaggtgttcagcgtggccgtgatgccctgcacctgcaagaaggccgaggcccagcgccccggcatggagcacgacggcgtgcgcgacgtggacgccgtgctgaccaccggcgagctggccgccatgctgcgccaggcccacatcgacttcgccgccctgcccgacgagcccttcgaccgccccctgggcagctacagcggcgccggcaacatcttcggcctgaccggcggcgtgatggaggccgccctgcgcaccgcctacgagctggtgaccggcgagcccgtgccctgcaccgagctggtgtacgtgcgcggcggcgagggcatccgccacgccaccctgaccatggacggccgcaccttccgcgtggccgtggtggccggcctgcagcacgtgcgccccctgctggaggccgtgcgcgccggcacctgcgacgtgaacttcgtggaggtgatgtgctgcccccagggctgcatcagcggcggcggccagcccaaggtgctgctgcccttccagcgcgacgaggtgtacgccgcccgcaaggccgccctgtaccgccacgacgccgagctggcctgccgcaagagccacgagaacccccaggtgcaggccctgtaccgcgagttcctgggcgagcccctgagccacgtgagccacaacctgctgcacaccgtgtacggccagacccgctaa

SEQ ID NO: 229 - DNA, 1665 bp, Desulfitobaccerium hafniense
atgatgcagctgaagcaccccttccagagcggcttccagcagcagagctgcaagcgccacaccaagaaggtggtggtggacatggagagcaaggccggcaagggcagcaacctgagccgccgcagcttcctgaagttcgccggcggcgccggcatcgccggcgccagcctgagcctgaccggctgcggccagcccctgacccccgccagcgccgtgggcggcgagggctggatgcccacccagtacaacgagcccggcggctggcccaccaacgtgcgcggccgcgtgcccatcgaccccgagaaccccgccctgcgccgcgacgaccagaagtgcatcctgtgcggccagtgcatcgaggtgtgcaagaccatccagagcgtgtacggcaactacgagctgcccctgaagaacgagatcccctgcatcaactgcggccagtgcatccactggtgccccagcggcgccatcagcgagcgcgaggacatcgaccaggtggccaaggccctggccgaccccaagatcaccgtggtggtgcagaccgcccccgccacccgcatcggcctgggcgaggagttcggcctgcccgtgggcaccaacgtgcagggcaagcaggtggccgccctgcgcaagctgggcttcgacgtgatcttcgacaccaacttcgccgccgacctgaccatcatggaggagggcaccgagctggtgaagcgcatcaccggcgagctgcaccaccccctgccccagttcaccagctgctgccccggctgggtgaagttcgtggagtactactaccccgagctgctgcccaacctgagcagcgccaagagcccccagcagatggccggcgccctggtgaagacctacttcgccgagaagaaccacgtggagccccagaagatcttcagcgtggccatcatgccctgcaccgccaagaagttcgagtgccagcgccccgagatgatcagcgcccagacctactggcaggacgagcaggtgagccccgacgtggacgtggtgctgaccacccgcgagctggcccgcatgatcaagcgcgccggcatcgacctgcccagcctgcccgacgaggagtacgaccagctgatgggcgtggccaccggcgccggcgccatcttcggcaccaccggcggcgtgatggaggccgccgtgcgcagcgcctactacctggtgaccggcgagcagccccccgccgccctgtggcagctgacccccgtgcgcggcatggagggcgtgaaggaggccgccgtgagcatccccggcgccggcgagatccgcatcgccgtgatcagcggcctggacaacgcccgcgccatcatggagcaggtgaaggccggcaacagcccctggaccttcatcgaggtgatggcctgccccggcggctgccagtacggcggcggccagccccgcagcagcgccccccccagcgacggcgtgcgcaacacccgcgccgccagcctgtacaagatcgacgcccaggccaagctgcgcaacagccacgacaacccccagatcaagcaggtgtacgccgagttcctgaccagccccctgagcgagaaggccgaggagctgctgcacacccactacatcagccgcgccgaggagttcgacgccaagaagccccagagccacgagtacgaggtgtaa

SEQ ID NO: 230 - DNA, 1737 bp, Eubaccerium acidaminophilum
atggtgaacatcaccatcgacggccgccaggtgaccgtgcccgccaacagcaccgtgctggacgccgcccgcgacatgggcatcaacatccccaccctgtgctacctgaaggacatcaacaagaccggcgcctgccgcatgtgcctggtggaggtggagggcatccgcaacctgcagaccgcctgcaccttccccgtgcgcgacggcctggtggtgaagaccaacaccaagcgcgtgcgcgacgcccgccgcgacaacctgcagctgatcctgagcaaccaccaccgcgactgcctgagctgcttccgcaacggcagctgcgagctgcaggccctgtgcgacgacatgggcctgagcgagctggacttcgaggcccccaaggagctgaagcccgtggacatgctgagccacagcatcgtgcgcgaccccaacaagtgcatcctgtgcggccgctgcgtggccgtgtgcaacaaggtgcaggaggtgggcatcctggccttcaccaaccgcggcgtggagaccgaggtggcccccgccttcgccaccagcatggccgacgccccctgcatctactgcggccagtgcgtgaacgtgtgccccgtggccgccctgcgcgagaagaccgacatcgagaaggtgtgggaggtgctggaggacgagaccaagcacgtggtggtgcaggtggcccccgccgtgcgcgccgccctgggcgagatgttcggcaaccccatcggcacccgcgtgaccggcaagatgttcaccgccctgaagatgctgggcttccagaaggtgttcgacaccaacttcgccgccgacctgaccatcatggaggagggcaccgagctgctgggccgcatcaagaacggcggcaccctgcccatgatcaccagctgcagccccggctggatccgctacgtggagcacttctaccccgagctgctggaccacgtgagcagctgcaagagcccccagcagatgatgggcgccgtgctgaagagctactacgccgagaagaacaacatcgcccccgagaacatgatcgtggtgagcgtgatgccctgcatcgccaagaagaccgagagcgccaaggaggagatgaagaacgtgcacggcacccgcgacgtggacatcgtgctgaccacccgcgagctgggcaagatgatcaaggaggcccgcatcgagttcaacgacctgcaggacagcaaccccgacgagttcttcggcgactacaccggcgccgccgtgatcttcggcgccaccggcggcgtgatggaggccgccatccgcaccgtggccgacatcgtgagcggccaggagctggaggacatcgagtacaccgccgtgcgcggcctggagggcatcaaggaggccgccgtgaagatcggcgacctggaggtgaaggtggccgtggcccacggcaccgccaacgccggcaagctgatggacctggtgcgcgacggcaaggccgactaccacttcatcgagatcatgggctgcagcggcggctgcgtgaccggcggcggccagccccacgtggacagccgcaccaaggagaaggtgaacgtgaagctggagcgcgccaaggccctgtacaccgaggacaagctgcgcgacaagcgcaagagccaccacaacgagagcgtgaagcgcctgtacgaggagtacctgggcaagcccaacggccacaaggcccacgagctgctgcacacccactacaagaagcgcgagctgttctaa

SEQ ID NO: 231 - DNA, 1860 bp, Rhodopseudomonas palustris
atgtgcacccccgaccaggccagcctgagcgcccgcgaccccgccgaggccaccatcaccctgagcatcaacggcgtggcctgcgccggcttcgccaacgagaccatcctgagctgcgcccgccgctacgacgtgtacatccccaccctgtgcgagctggaggacatcgaccacacccccggcgcctgccgcgtgtgcctggtggagatcctgcaggccggcaaggacaccccccagatcgtgaccgcctgcaacacccccgtgcgcgacggcatggaggtgcagacccgcagcaagaaggcccgcgacatgcagcgcctgcaggtggagctgctgatggccgaccacctgcaggactgcgccacctgcatccgccacggcagctgcgagctgcaggacctggcccagttcgtgggcctgcagcagaaccgcttcttcgaccgcgagcgcaccgaggcccgccccgtggaccacagcagccccagcatggtgcgcgacatgcgccgctgcgtgcgctgccagcgctgcgtggccatctgccgctaccaccagaagatcgacgccctggccatcgagggcagcggcctggagcgcatggtggccctgcgcgacgccgacggctaccccaacagcgtgtgcgtgagctgcggccagtgcgtgctggtgtgccccaccggcgccctgggcgagcgcgacgagaccgaccgcgccctggactacatctgcgaccccaacgtggtgaccgtggtgcagttcgcccccgccgtgcgcgtggccttcggcgaggagttcggcctgcccgccggcaccaacgtggagggccagatcatcgccgcctgccgcaagctgggcgtggacgtggtgctggacaccaacttcgccgccgacgtggtgatcatggaggagggcgccgagctgctggcccgcctgaagcagggccgccgccccaccttcaccagctgctgccccgcctggatcaacttcgccgagatccactaccccgacgtgctgcccctgctgagcagcaccaagagcccccagcaggtgctgagcaccatcgccaagagctacctgcccgcccagctgggcgtgcccgccgagcgcatccgcgtgatcagcatcatgccctgcatcgccaagaaggacgaggccgtgcgcccccagatggtgcacgacggccagcccgagaccgacctggtgctgaccacccgcgagttcgcccgcctgctgcgccgcgagggcatcgacctgaaggacctgcccagcagccagttcgaccgccccttcctgagcgcctacagcggcgccggcgccatcttcggcaccaccggcggcgtgatggaggccgccgtgcgcaccatctacgccctggtgaacggccgcgagctggagcgcatcgagctgacccagctgcgcggcttcgagggcctgcgcgaggccaccgtggacctgggcgcccccgtgggcgaggtgaaggtggccatggtgcacggcctgggcgacacccgcaagctggtggagagcgtgctgagcggcgaggccaactacgacttcatcgaggtgatggcctgccccggcggctgcgtggacggcggcggcagcctgcgcagcaagaaggcctacctgcccctggccctgaagcgccgcgagaccatctacaacgtggaccgcgccgccaaggtgcgccagagccacaacaacccccaggtgcaggccctgtaccgcgagctgctgcaggcccccaacagcgagatcgcccaccgcctgctgcacacccactacgccagccgcaagcgcgagctgcagcacaccgtgaaggagatctgggacgacctgaccatgagcaccatcctgtactaa

SEQ ID NO: 232 - DNA, 1935 bp, Clostridium thermocellum
atggacagcttcctgatgaagggctacatcaaggaggccaacatcgactacagctgcagccgcggcagcatggaggacctgcccaagtgggagttccgcgagatccccaaggtgccccgcgccgtgatgcccagcctgagcctggaggagcgcaagaacaacttcaacgaggtggagctgggcctgagcgaggaggtggcccgcaaggaggcccgccgctgcctgaagtgcggctgcagcgcccgcttcacctgcgacctgcgcaaggaggccagcaaccacggcatcgtgtacgaggagcccatccacgaccgcccctacatccccaaggtggacgaccaccccttcatcgtgcgcgaccacaacaagtgcatcagctgcggccgctgcatcgccgcctgcgccgagatcgagggccccggcgtgctgaccttctacatgaagaacggccgccagctggtgggcaccaagagcggcctgcccctgcgcgacaccgactgcgtgagctgcggccagtgcgtgaccgcctgcccctgcgccgccctggactaccgccgcgagcgcggcaaggtggtgcgcgccatcaacgaccccaagaagaccgtggtgggcttcgtggcccccgccgtgcgcagcctgatcagcaacaccttcggcgtgagctacgaggaggccagccccttcatggccggcctgctgaagaagctgggcttcgacaaggtgttcgacttcaccttcgccgccgacctgaccatcgtggaggagaccaccgagttcctgagccgcatccagaacaagggcgtgatgccccagttcaccagctgctgccccggctggatcaacttcgtggagaagcgctaccccgagatcatcccccacctgagcacctgcaagagcccccagatgatgatgggcgccaccgtgaagaaccactacgccaagctgatgggcatcaacaaggaggacctgttcgtggtgagcatcgtgccctgcctggccaagaagtacgaggccgcccgccccgagttcatccacgacggcatccgcgacgtggacgccgtgctgaccaccaccgagatgctggagatgatggagctggccgacatcaagcccagcgaggtggtgccccaggagttcgacgagccctacaagcaggtgagcggcgccggcatcctgttcggcgccagcggcggcgtggccgaggccgccctgcgcatggccgtggagaagctgaccggcaaggtgctgaccgaccacctggagttcgaggagatccgcggcttcgagggcgtgaaggagagcaccatcgacgtgaacggcaccaaggtgcgcgtggccgtggtgagcggcctgaagaacgccgagcccatcatcgagaagatcctgaacggcgtggacgtgggctacgacctgatcgaggtgatggcctgccccggcggctgcatctgcggcgccggccaccccgtgcccgagaagatcgacagcctggagaagcgccagcaggtgctggtgaacatcgacaaggtgagcaagtaccgcaagagccaggagaaccccgacatcctgcgcctgtacaacgagttctacggcgagcccaacagccccctggcccacgagctgctgcacacccactacacccccaagcacggcgacagcacctgcagccccgagcgcaagaagggcaccgccgccttcgacgtgcaggagttcaccatctgcatgtgcgagagctgcatggagaagggcgccgagaacctgtacaacgacctgagcagcaagatccgcctgttcaagatggaccccttcgtgcagatcaagcgcatccgcctgaaggagacccaccccggcaagggcgtgtacatcgccctgaacggcaagcagatcgaggagcccatgctgagcggcaacatccccgacgagagcgagagcgagtaa

SEQ ID NO: 233 - DNA, 1719 bp, Clostridium perfringens; identical to SEQ ID NO: 205

SEQ ID NO: 234 - DNA, 1752 bp, Clostridium thermocellum
gtgcacgtgctgaagctggtgcacagcacccagtactggcgcgccgaggagatggacaaccgcgagtacatgctgatcgacggcatccccgtggagatcaacggcgagaagaacctgctggagctgatccgcaaggccggcatcaagctgcccaccttctgctaccacagcgagctgagcgtgtacggcgcctgccgcatgtgcatggtggagaacgagtggggcggcctggacgccgcctgcagcacccccccccgcgccggcatgagcatcaagaccaacaccgagcgcctgcagaagtaccgcaagatgatcctggagctgctgctggccaaccactgccgcgactgcaccacctgcaacaacaacggcaagtgcaagctgcaggacctggccatgcgctacaacatcagccacatccgcttccccaacaccgccagcaaccccgacgtggacgacagcagcctgtgcatcacccgcgaccgcagcaagtgcatcctgtgcggcgactgcgtgcgcgtgtgcaacgaggtgcagaacgtgggcgccatcgacttcgcctaccgcggcagcaagatgaccatcagcaccgtgttcgacaagcccatcttcgagagcaactgcgtgggctgcggccagtgcgccctggcctgccccaccggcgccatcgtggtgaaggacgacacccagaaggtgtggaaggagatctacgacaagaacacccgcgtgagcgtgcagatcgcccccgccgtgcgcgtggccctgggcaaggagctgggcctgaacgacggcgagaacgccatcggcaagatcgtggccgccctgcgccgcatgggcttcgacgacatcttcgacaccagcaccggcgccgacctgaccgtgctggaggagagcgccgagctgctgcgccgcatccgcgagggcaagaacgacatgcccctgttcaccagctgctgccccgcctgggtgaactactgcgagaagttctaccccgagctgctgccccacgtgagcacctgccgcagccccatgcagatgttcgccagcatcatcaaggaggagtacagcaccagcagcaagcgcctggtgcacgtggccgtgatgccctgcaccgccaagaagttcgaggccgcccgcaaggagttcaaggtgaacggcgtgcccaacgtggactacgtgctgaccacccaggagctggtgcgcatgatcaaggagagcggcatcgtgttcagcgagctggagcccgaggccatcgacatgcccttcggcacctacaccggcgccggcgtgatcttcggcgtgagcggcggcgtgaccgaggccgtgctgcgccgcgtggtgagcgacaagagccccaccagcttccgcagcctggcctacaccggcgtgcgcggcatgaacggcgtgaaggaggccagcgtgatgtacggcgaccgcaagctgaaggtggccgtggtgagcggcctgaagaacgccggcgacctgatcgagcgcatcaaggccggcgagcactacgacctggtggaggtgatggcctgccccggcggctgcatcaacggcggcggccagcccttcgtgcagagcgaggagcgcgagaagcgcggcaagggcctgtacagcgccgacaagctgtgcaacatcaagagcagcgaggagaaccccctgatgatgaccctgtacaagggcatcctgaagggccgcgtgcacgagctgctgcacgtggactacgccagcaagaaggaggccaagtaa

SEQ ID NO: 235 - DNA, 1320 bp, Desulfovibrio desulfuricans
atggccggctgcaaggcccagcacccccccgccgcctacctggccggcctggaggtgcccgccgccggcagcgaggtgaccatggagggcgtgcgctacaagatgaacgcccccaaggacgtggaccccgccaccatccgcttcgtggaggtggaccacgacaagtgcatggcctgcggcgagtgcgagtaccactgccccaccggcgtgatgcaggaggtgaccgaggacggctaccgcggcgtggtggaccccgtggcctgcgtgaactgcggccagtgcctggccaactgccccttcggcgccatccacgaggaggtgagcttcgtgggcgagctgtacgagaagctgaaggaccccgacaccgtggtggtgagcatgcccgcccccgccgtgcgctacgccctgggcgagtgcttcggcctgcccaccggcacctacgtgggcggccagatgcacgccgccctgcgccgcctgggcttcaacctggtgtgggacaccgagtggaccgccgacgtgaccatcatggaggagggcaccgagctgctggagcgcgtgaagcacggcaacatgcccctgccccagttcaccagctgctgccccggctggatcaagttcgccgagaccttctaccccgacctggagaagcacctgagcacctgcaagagccccatcgccatgatcggccccctggccaagacctacggcgcccaggaggccggcgtgcccgccaagaagatgtacaccgtgagcatcatgccctgcatcgccaagaagttcgagggcatgcgccccgagatgaacgccagcggctaccgcgacatcgacgccaccatcaccacccgcgagctggcctggatgatcaagaaggccggcatcgacttcaccagcctgcccagcgaggagcccgaccccgccctgggcatgagcaccggcgccgccaccatcttctgcaccagcggcggcgtgatggaggccgccctgcgcctggcctacgaggccctgagcggcggcaccctggccgaccccgacatcaaggtggtgcgcacccacgagggcatcaacaccgccgaggtgcccgtgcccaacttcggcaccgtgaaggtggccgtggccagcggcctggacaacgccgccaagctgtgcgaggaggtgcgcgccggcaagagcccctaccacttcatcgaggtgatgacctgccccggcggctgcgtgaacggcggcggccagcccctggagcccggcatgctgcagagcagcctgttcaagagcaccatcaccaagatcaaccgccgcttcacccgccgcagcgtggcctaa

SEQ ID NO: 236 - DNA, 1137 bp, Desulfovibrio desulfuricans
atgaacctggtggagatggagaagatccagtacgtggaccagagccccgacccccgcgccaaccccgacgagctgttcttcatccagatcgaccccgagaagtgcatcggctgcgacacctgccaggagtactgccccaccggcgccatcttcggcgacaccggcagcgcccacagcatcccccacgaggagatctgcatcaactgcggccagtgcctgacccactgccccgtgggcgccatctacgaggtgcagagctgggtgcgcgagctgagcgagaagatcaaggaccccgagatcaaggtgatcgccatgcccgcccccgccgtgcgctacggcctgggcgagtgcttcggcatgcccgtgggcaccgtgaccaccggcaagatgctgaccgccctgcagatgctgggcttcgaccacgtgtgggacaacgagttcaccgccgacgtgaccatctgggaggagggcaccgagttcgtgaagcgcctgaccggccagatcgacaagcccctgccccagttcaccagctgctgccccggctggcacaagtacgtggagagcttctaccccgagctgttcccccacctgagcagctgcaagagccccatcggcatgatgggcgccctggccaagacctacggccccgacgtgatgaagtacgaccgcagcaaggtgtacaccgtgagcatcatgccctgcaccgccaagaagtacgagggcatgcgcgccgacctgtggagcagcggctacaaggacatcgacgccaccatcgacacccgcgagctggcctacatgatcaagaaggccggcatcgacttcgccgccctgcccgacggcaagcgcgacaccctgatgggcgacagcaccggcggcgccaccatcttcggcgtgagcggcggcgtgatggaggccgccctgcgctacgcctacgaggccgtgaccggcaagaagcccagcagctgggacttcaccatggtgcgcggcctgaacggcatcaaggagggcaccgtgaccatcggcgacgccaagatcaacgtggccgtggtgcacggcgccaagcgcttcgccgaggtgtgcgaggtgatcaagaccggcaagagcccctgcatcagcagcagcctgtgcctgccccgc

SEQ ID NO: 237 - DNA, 1266 bp, Desulfovibrio desulfuricans
atgaacctggtggagatggagaagatccagtacgtggaccagagccccgacccccgcgccaaccccgacgagctgttcttcatccagatcgaccccgagaagtgcatcggctgcgacacctgccaggagtactgccccaccggcgccatcttcggcgacaccggcagcgcccacagcatcccccacgaggagatctgcatcaactgcggccagtgcctgacccactgccccgtgggcgccatctacgaggtgcagagctgggtgcgcgagctgagcgagaagatcaaggaccccgagatcaaggtgatcgccatgcccgcccccgccgtgcgctacggcctgggcgagtgcttcggcatgcccgtgggcaccgtgaccaccggcaagatgctgaccgccctgcagatgctgggcttcgaccacgtgtgggacaacgagttcaccgccgacgtgaccatctgggaggagggcaccgagttcgtgaagcgcctgaccggccagatcgacaagcccctgccccagttcaccagctgctgccccggctggcacaagtacgtggagagcttctaccccgagctgttcccccacctgagcagctgcaagagccccatcggcatgatgggcgccctggccaagacctacggccccgacgtgatgaagtacgaccgcagcaaggtgtacaccgtgagcatcatgccctgcaccgccaagaagtacgagggcatgcgcgccgacctgtggagcagcggctacaaggacatcgacgccaccatcgacacccgcgagctggcctacatgatcaagaaggccggcatcgacttcgccgccctgcccgacggcaagcgcgacaccctgatgggcgacagcaccggcggcgccaccatcttcggcgtgagcggcggcgtgatggaggccgccctgcgctacgcctacgaggccgtgaccggcaagaagcccagcagctgggacttcaccatggtgcgcggcctgaacggcatcaaggagggcaccgtgaccatcggcgacgccaagatcaacgtggccgtggtgcacggcgccaagcgcttcgccgaggtgtgcgaggtgatcaagaccggcaagagcccctggcacttcatcgagttcatggcctgccccggcggctgcgtgtgcggcggcggccagcccgtgatgcccggcgtgctggaggccatggaccgcaaggtgagccgcaccttcgccggcctgaaggagcgcctgaaccgcatgagcagcagcaaggcctaa

SEQ ID NO: 238 - DNA, 1107 bp, Trichomonas vaginalis
tgcgacggcaagtggctgagccccgcctgcgtgaccaccgtgtgggacggcctgaagatcgacaccaagagcaagaacgtgcgcgacagcgtggagaacaacctgaaggagctgctggactgccacgacgagacctgcagcgcctgcatcgccaaccaccgctgccagttccgcgacatgaacgtggcctacagcgtgaaggccgagaccaaggagatctgcagcgaggagggcatcgacgagagcaccaacgccatccgcctggacaccagcaagtgcgtgctgtgcggccgctgcatccgcgcctgcgaggaggtggccggcaccagcgccatcatcttcggcaaccgcgccaagaagatgcgcatccagcccaccttcggcgtgaccctgcaggagaccagctgcatcaagtgcggccagtgcaccctgtactgccccgtgggcgccatcaccgagaagagccaggtgaaggaggccctggacatcctggccaacaagggcaagaagatcaccgtggtgcaggtggcccccgccgtgcgcgtggccctgagcgaggccttcggctacaaggagggcaccgtgaccaccggcaagatggtgagcgccctgaaggccctgggcttcgacctggtgtacgacaccaactacggcgccgacctgaccatctgcgaggaggccggcgagctggtgaaccgcctgcgcgaccccaacgccaagttccccatgttcaccagctgctgccccgcctgggtgaactacgtggagcagagcgcccccgacttcatccccaacctgagcagctgccgcagcccccagggcatgctgagcgccctgatcaagaactacctgcccaagctgctggacgtgaagcaggaggacgtgctgaacttcagcatcatgccctgcaccgccaagaaggacgaggtggagcgccccgagctgcgcaccaagagcggccccaaggagaccgacatggtgctgaccgtgcgcgagctggtggagatgatcaagctgagcaacatcgacttcaacaacctgcccgacacccagttcgacaacatcttcggcttcggcagcggcgccggccagatcttcgccgccacc

SEQ ID NO: 239 - DNA, 1107 bp, Trichomonas gallinae
tgcgacggcaagtggctgagccccgcctgcgtgaccaccgtgtgggacggcctgcgcatcgacaccaagagcaaggtggtgcgcgacagcgtggagaacaacctgaaggagctgctggactgccacgacgagacctgcagcagctgcgtggccaaccaccgctgccagttccgcgacatgaacgtggcctacagcgtgaaggccgacaccaaggagatctgcagcgaggagggcatcgacgagagcacccacgccatccgcctggacaccagcaagtgcgtgctgtgcggccgctgcatccgcgcctgcgaggaggtggccggcaccagcgccatcatcttcggcaaccgcgccaagcacatgcgcatccagcccaccttcggcggcaccctgcaggagaccgcctgcatcaagtgcggccagtgcaccctgtactgccccgtgggcgccatcaccgagaagagccaggtgaaggaggccctggacatcctggccaacaagggcaagaaggtgaccgtggtgcaggtggcccccgccgtgcgcgtggccctgagcgaggccttcggctacaaggagggcaccgtgaccaccggcaagatggtgagcgccctgaaggccctgggcttcgacctggtgtacgacaccaactacggcgccgacctgaccatctgcgaggaggccggcgagctggtgaaccgcctgaaggaccccaaggccgtgttccccatgttcaccagctgctgccccgcctgggtgaactacgtggagcagagcgcccccgacttcatccccaacctgagcagctgccgcagcccccagggcatgctgagcagcctgatcaagaactacctgcccaagctgctgggcatcaagcaggaggaggtgatgaacttcagcatcatgccctgcaccgccaagaaggacgagatcgagcgccccgagctgcagaccaagaccggcctgaaggagaccgacatggtgctgaccgtgcgcgagctggtggagatgatcaagctgagcaacatcgacttcaacaacctgcccgacacccccttcgacaacatcttcggcttcggcagcggcgccggccagatcttcgccgccacc

SEQ ID NO: 240 - DNA, 1368 bp, Nyctotherus ovalis
atgatcagccgcctgatcgccaagaaggcccccctgttcctgcgcaccttcgccaccagcgagatgatcagcctgaagatcgacggcaagatcatcagcgtgcccaagggcatcatgctggccgacgccatcaagaaggccggcgccaacgtgcccaccatgtgctaccaccccgacctgcccaccagcggcggcatctgccgcgtgtgcctggtggagagcgccaagagccccggctaccccatcatcagctgccgcacccccgtggaggagggcatggagatcgtgacccagggcagcaagatgaaggagtaccgccaggccaacctggccctgatgctgagccgccaccccaacgcctgcctgagctgcaccagcaacaccaactgcaagacccaggagctgagcgccaacatgaacatcggccagtgcggcttcgccaacgccaccccccccaagaacgacgacagctacgacatgaccaccgccatcgagcgcgacaacgacaagtgcatcaactgcgacatctgcgtgcacacctgcagcctgcagggcctgaacgccctgggcttctacaacgaggagggccacgccgtgaagagcatgggcaccctggacgtgagcgagtgcatccagtgcggccagtgcatcaaccgctgccccaccggcgccatcaccgagaagagcgagatccgccccgtgctggacgccatcaacatccagcagcgcctggtgttccagatggcccccagcatccgcgtggccgtggccgaggagttcggcatcaagcccggcgagaagatcctgaagaacgagatcgccaccgccctgcgcaagctgggcagcaacgtgttcgtgctggacaccaacttcagcgccgacctgaccatcatcgaggagggccacgagctgatcgagcgcctgtaccgcaacgtgaccggcaagaagctgctgggcggcgaccacatgcccatcgacctgcccatgctgaccagctgctgccccggctggatcatgttcatcgagaagaactaccccgacctgctgaacaacctgagcacctgcaagagcccccagggcatgctgggcgccctgatcaagggctactgggccaagaacatcaagaagatggaccccaaggacatcgtgagcgtgagcatcatgccctgcaccgccaagaaggccgagaaggagcgcccccagctgcgcggcgacgagggctacaaggacgtggactacatcctgaccacccgcgagctggccaagatgctgaagcagagcaacatcgacctggccaagatggagcccacccccttcgacaaggtgatgagcgagggcaccggcgccgccgtgatcttcggcgtgacc

SEQ ID NO: 241 - DNA, 1107 bp, Trichomonas vaginalis
tgcgacggcaagtggctggcccccgcctgcgtgaccaccgtgtgggacggcctgaagatcgacaccaagagcaagatggtgaaggagagcgtggagaacaacctgaaggagctgctggactgccacgacgagacctgcagcagctgcgtggccaaccaccgctgccagttccgcgacatgaacgtggcctacagcatcaaggccgagaccaaggaggagtgcagcgaggagggcatcgacgagagcaccaacagcatccgcctggacaccagcaagtgcgtgctgtgcggccgctgcatccgcgcctgcgaggaggtggccggccagagcgccatcatcttcggcaaccgcgccaagcacatgcgcatccagcccaccttcggccagaccctgcaggacaccagctgcatcaagtgcggccagtgcaccctgtactgccccgtgggcgccatcaccgagaagagccaggtgaagcaggccctggacatcctgagcaacaagggcaagaagatcagcgtgatccaggtggcccccgccgtgcgcgtggccctgagcgaggccttcggctacaaggagggcagcgtgaccaccggcaagatggtgagcgccctgaaggccctgggcttcgactacgtgtacgacaccaactacagcgccgacctgaccatcgtggaggaggccggcgagctggtgcagcgcctgaagaaccccaacgccgtgttccccatgttcaccagctgctgccccgcctgggtgaactacgtggagcagagcgcccccgacttcatccccaacctgagcagctgccgcagcccccagggcatgctgagcagcctggtgaagaactacctgcccaaggtgctgaacatccccgtggaggacgtgctgaacttcagcatcatgccctgcaccgccaagaaggacgagatcgagcgccccgagctgcgcaccaaggacggccacaaggagaccgacatggtgctgaccgtgcgcgagctggtggagatgatcaagctgagcggcatcgacttcaacaacctgcccgacacccccttcgacagcatcttcggcttcggcagcggcgccggccagatcttcgccgccacc

SEQ ID NO: 242 - DNA, 1395 bp, Entamoeba histolytica
cgcctgcacaccgtgaccggccacgaccacaaccacagcatccagttcgactggagcaagtgcatgggctgcggcatgtgcgccaccaagtgcaccttcggcgtgctggtgaagcagccccccaagatcccccccttcgtgcagcccaaccgcgagaagctgagccaggagaacaccgacaagacccgcgtgctgatcgacgagagcgagtgcaccggctgcggccagtgcagcctggtgtgcaacttcggcagcatcacccccatcgaccacctggtggacaccttcaaggccaaggaggccggcaagaagctggtggccatgatcgcccccagcacccgcctgggcgtggccgaggccatgggcatgcccatcggcagcaccgccatggcccagctggtgcactgcctgcgcctgatcggcttcgactacgtgttcgacgtggacgccggcgccgacaagaccaccatggacgactacgccgaggtgatcgagatgaagaaggagggcaagggccccgccatcaccagctgctgccccgcctggatcgagctggtggagaaggagtaccccgacctgatccccaacgtgagcaccgcccgcagccccatcggctgcctggccggctgcatcaagcgcggctgggccaaggacgtgggcatcgccgtggaggacctgtacaccgtgggcatcatgccctgcatcgccaagaagaccgagagccagcgccagcagatccaccaggactacgacgccagctgcaccagcaacgagatcgccgcctacttcaagaagcacctgccccccgaggagtgcaagttcacccaggagcgcgaggaggccctggccaagaccgaggacggccagtgcgacctgcccttccgccgcatcagcggcggcagcaacatcttcggccgcaccggcggcgtgtgcgagaccgtgctgcgcgtgatcgcccgcaacgccggcgtggactggaacagctgcaccgtgaacaaggaggagaccttcaagcacgccgccagcggcagcaccatgaccaacctgagcgtggacatcggcggcaccatcatcaccggcgccgtgtgccacggcggctacgccatccgccacgcctgcgagctgatccgcaagggcgagctgaaggtggacgtggtggagatgatggcctgcgtgggcggctgcctgggcggcgccggccagcccaagatcccccccgccaagaagctggagatggacaagcgccgcgtgatgctggacatcctggaccagcagaccgacatccgcgccgccaacgagaacaccgacgtgctgggctggatcgacaagcacttcgaccaccagggcgcccaccagcacctgcacacctacttcaccccccgctaccagaactaa

SEQ ID NO: 243 - DNA, 1425 bp, Giardia intestinalis
atgccccccaagccccagcacgacgtgaccggcgtggacagcaacaacgccatcatgatcgactacgccaagtgcatcggctgcaacatgtgcatcaaggcctgcgacgtgcagggcatcggcgtgtacaagcagaacgagaagcccaagtacccccccatcgtgaagctgagcaccctgttcaacagcgactgcatcggctgcggccagtgcgccaccatctgccccgtggacgccatcgcccccaagaacaacctggagatctacaagggcgagagcgccagcaagaaggtgcgcgtggccctgatcgcccccagcacccgcgtggccttcggcgacgtgttcggcctgcccatcggcaccaacaccatctacagcctgatccgcatgctgaagcagtacctgggcttcgactacgtgttcgacgtgaacttcggcgccgacgagaccaccgtgatcgacacccaggagctgctgcacttcaagcacgagggccgcggccccgtgttcaccagctgctgccccgcctgggtgaacctgtgcgagatgaagtaccccgagctgctgccccaggtgagcaccgccaagagctgcgtggccatggtggccaccctggtgaagcgccgctgggtgcaggagcacctgatccccaagggcatcgtggacagcgtggacgacgtgtacgtggccgacatcatgccctgcaccgccaagaaggacgagagcatgcgcccccagctgaaccgcgacgtggacatctgcctgaccgtgcgcgaggtggccgagcacctgtacttcctgcacggcgcccgcctgaccctggaggaggtggaggccgacgccctggtgctgcgccccggccgcagcacccagaagaagtgggacttcgacgcccccttcaacaccgtgagcggcggcagccacatcttcggcaagaccggcggcgtggccgagacctgcctgcgcttcatcagctacatgaagaagagccccatcgagaacgtgaaggaggagctgctgaaggagttcaagacccccggccagctggtgcagaccgtgaagctggtgagctgcgagatcgccggcgagacctaccgcgccctgatcgcccacggcggcagcgccatcaacgccgccgcccgcatggtgctgaacaaggaggtggagtgcgacgtggtggagcagatggcctgccccggcggctgccagaacggcggcggcatgcccaagatcaagggcaagaaggaggccgtgctgacccgcgccagcaccctggacatcctggacggcaaggagcgcttcgccagcgccggcgagaacaagaccctgtggggcttcaacggctgcctgaccgagcacgaggcccacgagctgctgcacacccactaccagcaccgccccgtggagagcctgctgccccagtaa

SEQ ID NO: 244 - DNA, 2535 bp, Desulfitobacterium hafniense
atggtgaagatcatcagcatcaccaacaacgccaagcgccagggcaagggcaccagccgcaaggagaagcaggccatgaaggaggtgaccaagcagcagcgcatccgcgtgaccgtgaacggccgccagatggaggtgtacggcgacctgaccatcctgcaggccctgctgcaggaggacatccacatcccccacctgtgctacgacatccgcctggagcgcagcaacggcaactgcggcctgtgcgtggtggagctgggcgagggcagcgagcagcaggacgtgaaggcctgccacacccccatccaggagggcatgatcatccacaccaacagcccccgcctggagcactaccgcaagatccgcctggagcagatcctggccgaccacaacgccgactgcgtggccccctgcgtgatgacctgccccgccaacatcgacatccagagctacctgagccacgccggcaacggcaacttcgagaccgccatcaaggtgatcaaggagcgcaaccccttccccatcgtgtgcggccgcgtgtgcccccacagctgcgaggcccagtgccgccgcaacctgatcgacgagcccgtggccatcaaccacgtgaagcgcttcatcgccgactgggacatcgcccacgagcagccctgggccccccgcaagaaggccgccaccggcaagaagatcgccgtggtgggcgccggcagcagcggcctgagcgccgcctactacagcgccatccagggccacgacgtgaccgtgttcgagcgccacccccgcgccggcggcatgatgcgctacggcatccccgagtaccgcctgcccaaggagaccctggaccgcgagatcggcctgatcgccgacctgggcgtgaagatcatgaccaacaaggccctgggcacccacatccgcctggaggacctgcaccaggacttcgacgccgtgtacctggccatcggcagctggcgcgccacccccctgcagatcgagggcgacaacctggagggcgtgtggctgggcatcaacttcctggagcaggtgaccaagggcgccgacatcaagctgggcgagcacgtggtggtgatcggcggcggcaacaccgccatcgactgcgcccgcaccgccctgcgcaagggcgccggcagcgtgaagctggtgtaccgccgcacccgcgaggagatgcccgccgagagctacgaggtggaggaggccatccacgagggcgtggagatgtacttcctgaccgccccccacaagatcgtggccgagggcggccgcaagctgctgcactgcatcaagatgaccctgggcgagcccgaccgcagcggccgccgccgccccatccccatcgagggcagcgagaccgccttcgaggccgacaccatcatcggcgccatcggccagagcaccaacacccagttcctgtaccacgacctgcccgtgaagctgaacaagtggggcgacatcgagatcaacggcaagaccatgcagaccagcgagatgaacatcttcgccggcggcgactgcgtgaccggccccgccaccgtgatccaggccgtggccgccggccgccacgccgccgaggccatggacagcttcctgatgaagggctacgtgaaggagcagcccatggactacagctgcagccgcggcagcctggaggacctgccccagtgggagttcgagaagatcccccgcctgaagcgcgcccccatgcccgccctgccccccgccgagcgccgcgacaacttccgcgaggtggagaccggcctgagcgaggagaccgcccgcgccgaggcccgccgctgcctgaagtgcggctgctacgagcgctacgactgcgacctgcgccaggaggccagcctgcaccacgtggagttcaagaagcccgtgcacgagcgcccctacatccccatcgtggaggaccacagcatcatcatccgcgaccacaacaagtgcatcagctgcggccgctgcatcgccgcctgcgccgaggtggagggccccgacatcctgagcttctacatgaagcacggccgccagctggtgggcaccaagagcggcctgcccctggaccagaccgactgcgtgagctgcggccagtgcgtgaacgcctgcccctgcggcgccctggactaccgcagcgagatcggccgcgtgttccgcgccatcaacgaccccggcaagaccaccgtggccttcgtggcccccgccgtgcgcagcgtggtgagcagccagtacggcgtgagctaccaggaggccagccgcttcatcgccggcctgctgaagaagatcggcttcgacaaggtgttcgacttcaccttcgccgccgacctgaccatcgtggaggagaccaccgagttcctgacccgcctgcagagccacaagcccatcccccagttcaccagctgctgccccggctgggtgaacttcgtggagcgccgctaccccgagatcatcccctacctgagcagctgcaagagcccccagatgatgatgggcgccaccgtgaagatcaccctgcgcaactaa

SEQ ID NO: 245 - DNA, 357 bp, Nyctotherus velox
atcctgttcatggagaagaactaccccgacatgctgaaccacctgagcacctgcaagagcccccagggcatgctgggcgccctgatcaagggctactgggccaagaacgtgaagaagatcgaccccaaggacgtggtgagcgtgagcatcatgccctgcaccgccaagaaggaggagaaggaccgcatcaccctgaagagcgacgagggctacaacaacgtggactacgtgctgaccacccgcgagctggccaagatgttcaagcagagcaacatcgaccccagcaagctgccccccacccagttcgacaacgtgatgagcgagggcaccggcgccgccgtgatcttcggcgtgacc

SEQ ID NO: 246 - DNA, 1431 bp, Oryza sativa
atggccagcagcagcagcagcgccagcagccgcttcagccccgccctgcaggccagcgacctgaacgacttcatcgcccccagccaggactgcatcatcagcctgaacaagggccccagcgcccgccgcctgcccatcaagcagaaggagatcgccgtgagcaccaacccccccgaggaggccgtgaagatcagcctgaaggactgcctggcctgcagcggctgcatcaccagcgccgagaccgtgatgctggagaagcagagcctgggcgacttcatcacccgcatcaacagcgacaaggccgtgatcgtgagcgtgagcccccagagccgcgccagcctggccgccttcttcggcctgagccagagccaggtgttccgcaagctgaccgccctgttcaagagcatgggcgtgaaggccgtgtacgacaccagcagcagccgcgacctgagcctgatcgaggcctgcagcgagttcgtgacccgctaccaccagaaccagctgagcagcggcaaggaggccggcaagaacctgcccatgctgagcagcgcctgccccggctggatctgctacgccgagaagaccctgggcagcttcatcctgccctacatcagcgccgtgaagagcccccagcaggccatcggcgccgccatcaagcaccacatggtgggcaagctgggcctgaagccccacgacgtgtaccacgtgaccgtgatgccctgctacgacaagaagctggaggccgtgcgcgacgacttcgtgttcagcgtggaggacaaggacgtgaccgaggtggacagcgtgctgaccaccggcgaggtgctggacctgatccagagccgcagcgtggacttcaagaccctggaggagagccccatggaccgcctgctgaccaacgtggacgacgacggccagctgtacggcgtgagcggcggcagcggcggctacgccgagaccgtgttccgccacgccgcccacgtgctgttcgaccgcaagatcgagggcagcgtggacttccgcatcctgcgcaacagcgacttccgcgaggtgaccctggaggtggagggcaagcccgtgctgaagttcgccctgtgctacggcttccgcaacctgcagaacatcatccgcaagatcaagatgggcaagtgcgagtaccacttcatcgaggtgatggcctgccccagcggctgcctgaacggcggcggccagatcaagcccgccaagggccagagcgccaaggacctgatccagctgctggaggacgtgtacatccaggacgtgagcgtgagcaaccccttcgagaaccccatcgccaagcgcctgtacgacgagtggctgggccagcccggcagcgagaacgccaagaagtacctgcacaccaagtaccaccccgtggtgaagagcgtggccagccagctgcagaactggtaa

SEQ ID NO: 247 - DNA, 342 bp, Psalteriomonas lanterna
atcaacctggtggagaagcactaccccgagtacctgcccaacctgagcagctgccgcagcccccagggcatgctgagcagcctgatcaagaactactgggccaagaagatgggcatcgagcccaaggacgtggtggtggtgagcttcatgccctgcggcgccaagaaggacgagatcaagcgcccccagctgaagggcgagaccgactacgtgctgaccacccgcgagctgggcaagctgttcaagatgggcggcctgaacgacctgagcgtgctggagcccgtgaagtacgacgaccccctgggcgagagcaccggcgccgccgtgatcttcggcgccacc

SEQ ID NO: 248 - DNA, 357 bp, Nyctotherus ovalis
atcatgttcatggagaagaactaccccgacatgctgaaccacctgagcacctgcaagagcccccagggcatgctgggcgccctgatcaagggctactgggccaagaacatcaagaagatggaccccaaggacatcgtgagcgtgagcatcatgccctgcaccgccaagaaggccgagaaggagcgcccccagctgcgcggcgacgagggctacaaggacgtggactacatcctgaccacccgcgagctggccaagatgctgaagcagagcaacatcgacctgggcaagatggagcccacccccttcgacaaggtgatgagcgagggcaccggcgccgccgtgatcttcggcgtgacc

SEQ ID NO: 249 - DNA, 357 bp, Nyctotherus ovalis
atcatgttcatggagaagaactaccccgacatgctgaaccacctgagcacctgcaagagcccccagggcatgctgggcgccctgatcaagggctactgggccaagaacgtgaagaagatggaccccaaggacatcgtgagcgtgagcatcatgccctgcaccgccaagaaggccgagaaggagcgcccccagctgcgcggcgacgagggctacaaggacgtggactacatcctgaccacccgcgagctggccaagatgctgaagcagagcaacatcgacctgggcaagatggagccccgccccttcgacaaggtgatgagcgagggcaccggcgccgccgtgatcttcggcgtgacc

SEQ ID NO: 250 - DNA, 723 bp, Desulfitobacterium hafniense
atggccgtggagaagctgaccggcgaggtgctgaccgaccagctggactaccaggaggtgcgcggcctgcagggcatcaaggaggccgccgtggaggccaagggcaagaaggtgaacgtggccgtgatcagcggcctgcacaacgtggagcccatcctggagaagatcatcgagggcatggaggtgggctacgacctgatcgaggtgatggcctgccccggcggctgcatctgcggcgccggccaccccgtgcccgagaagatcgacaccctggagaagcgccagcaggtgctggtgaacatcgaccagaccagccgctaccgcaagagccaggagaaccccgacatcctgcgcctgtacgacgagtactacggcgaggccaacagccccctggcccacaagctgctgcacacccactacgaggccgtgaagcgcgagcccgtggccaagcacgaccgccgcatggccgacagcgccttcgtgacccacgagctgaccctgtgcacctgcgacaagtgcaccgcccagggcagccgcgagctgttcgccgccctgagcggcaagatccgcaagctgaagatggacagcttcgtgaccgcccgcaccatccgcctgaaggagaaccaccccggccagggcgtgtacgccgccatcgacggcaagctgatcgagacccccgtggagcagctggagcagcgcatcttccagcacctgatccgctaa

SEQ ID NO: 251 - DNA, 261 bp, Desulfitobacterium hafniense
gtggtgagcatcgtgccctgcatcgccaagaagtacgaggccgcccgccccgagttccgcagcgagggcatccgcgacgtggacgccgtgctgaccagcaccgagatgctggagatggccgacatcaagctgatcgagcccgccgacgtggagccccaggacttctgcgagccctacaagcgcgtgagcggcgccggcatcctgttcggcgccagcggcggcgtggccaagcgcccctgcggctggcgctggcgcaactaa

SEQ ID NO: 252 - DNA, 1434 bp, Drosophila melanogaster
atgagccgcctgagccgcgccctgcagctgaccgacatcgacgacttcatcacccccagccagatctgcatcaagcccgtgcagatcgacaaggcccgcagcaagaccggcgccaagatcaagatcaagggcgacggctgcttcgaggagagcgagagcggcaacctgaagctgaacaaggtggacatcagcctgcaggactgcctggcctgcagcggctgcatcaccagcgccgaggaggtgctgatcacccagcagagccgcgaggagctgctgaaggtgctgcaggagaacagcaagaacaaggccagcgaggactgggacaacgtgcgcaccatcgtgttcaccctggccacccagcccatcctgagcctggcctaccgctaccagatcggcgtggaggacgccgcccgccacctgaacggctacttccgcagcctgggcgccgactacgtgctgagcaccaaggtggccgacgacatcgccctgctggagtgccgccaggagttcgtggaccgctaccgcgagaacgagaacctgaccatgctgagcagcagctgccccggctgggtgtgctacgccgagaagacccacggcaacttcctgctgccctacgtgagcaccacccgcagcccccagcagatcatgggcgtgctggtgaagcagatcctggccgacaagatgaacgtgcccgccagccgcatctaccacgtgaccgtgatgccctgctacgacaagaagctggaggccagccgcgaggacttcttcagcaaggccaacaacagccgcgacgtggactgcgtgatcaccagcgtggaggtggagcagctgctgagcgaggcccagcagcccctgagccagtacgacctgctggacctggactggccctggagcaacgtgcgccccgagttcatggtgtgggcccacgagaagaccctgagcggcggctacgccgagcacatcttcaagtacgccgccaagcacatcttcaacgaggacctgaagaccgagctggagttcaagcagctgaagaaccgcgacttccgcgagatcatcctgaagcagaacggcaagaccgtgctgaagttcgccatcgccaacggcttccgcaacatccagaacctggtgcagaagctgaagcgcgagaaggtgagcaactaccacttcgtggaggtgatggcctgccccagcggctgcatcaacggcggcgcccagatccgccccaccaccggccagcacgtgcgcgagctgacccgcaagctggaggagctgtaccagaacctgccccgcagcgagcccgagaacagcctgaccaagcacatctacaacgacttcctggacggcttccagagcgacaagagctacgacgtgctgcacacccgctaccacgacgtggtgagcgagctgagcatcagcctgaacatcaactggtaa

SEQ ID NO: 253 - DNA, 1617 bp, S.pombe
atggccaagctgagcgtgaacgacctgaacgacttcctgagccccggcgccgtgtgcatcaagcccgcccaggtgaagaagcaggagagcaagaacgacatccgcatcgacggcgacgcctactacgaggtgaccaaggacaccggcgagaccagcgagctgggcatcgccagcatcagcctgaacgactgcctggcctgcagcggctgcatcaccagcgccgagaccgtgctggtgaacctgcagagctaccaggaggtgctgaagcacctggagagccgcaagagccaggagatcctgtacgtgagcctgagcccccaggtgcgcgccaacctggccgcctactacggcctgagcctgcaggagatccaggccgtgctggagatggtgttcatcggcaagctgggcttccacgccatcctggacaccaacgccagccgcgagatcgtgctgcagcagtgcgcccaggagttctgcaacagctggctgcagagccgcgcccacaagaaccagaaccaggtgaccaacagcgtggtgaacgagcaccccctgatcccccacagcaccagccagatcagcggcgtgcacagcaacaccagcagcaacagcggcatcaacgagaacgccgtgctgcccatcctgagcagcagctgccccggctggatctgctacgtggagaagacccacagcaacctgatccccaacctgagccgcgtgcgcagcccccagcaggcctgcggccgcatcctgaaggactgggccgtgcagcagttcagcatgcagcgcaacgacgtgtggcacctgagcctgatgccctgcttcgacaagaagctggaggccagccgcgacgagttcagcgagaacggcgtgcgcgacgtggacagcgtgctgacccccaaggagctggtggagatgttcaagttcctgcgcatcgaccccatcgagctgaccaagaaccccatccccttccagcagagcaccgacgccatccccttctggtacccccgcatcacctacgaggagcagatcggcagcagcagcggcggctacatgggctacgtgctgagctacgccgccaagatgctgttcggcatcgacgacgtgggcccctacgtgagcatgaacaacaagaacggcgacctgaccgagtacaccctgcgccaccccgagaccaacgagcagctgatcagcatggccacctgctacggcttccgcaacatccagaacctggtgcgccgcgtgcacggcaacagcagcgtgcgcaagggccgcgtgctgctgaagaagcgcgtgcgcagcaacgcccagaaccccaccgaggagcccagccgctacgactacgtggaggtgatggcctgccccggcggctgcatcaacggcggcggccagctgcccttccccagcgtggagcgcatcgtgagcgcccgcgactggatgcagcaggtggagaagctgtactacgagcccggcacccgcagcgtggaccagagcgccgtgagctacatgctggagcagtgggtgaaggaccccaccctgacccccaagttcctgcacaccagctaccgcgccgtgcagaccgacaacgacaaccccctgctgctggccaacaagtggtaa

SEQ ID NO: 254 - DNA, 357 bp, Metopus contortus
atcatcttcgccgagaagaactaccccgagatggtgaaccacctgagcaccaccaagagccccatgcagatgctgagcagcctgagcaagggctactgggccaaggagggcaagaagatcgaccccaagaacgtggtgaacgtggccatcatgccctgcaccgccaagaaggcctggaaggagcgccccgacatgaaggccgacaacggcgaccccgtgaccgactacgtgctgaccacccgcgagctgggcaccatgctgcgccagagcaacatcaaccccgtgagcctgcccaagacccccttcgacaagatcatgggcgagagcaccggcgccgccgtgatcttcggcgccacc

SEQ ID NO: 255 - DNA, 1389 bp, Mus musculus
atgaagtgcgagcactgcacccgcaaggagtgcagcaagaagagcaagaacgacgaccaggagaacgtgagcagcgacggcgcccagcccagcgacggcgccagccccgccaaggagagcgaggagaagggcgagttccacaagctggccgacgccaagatcttcctgagcgactgcctggcctgcgacagctgcgtgaccgtggaggagggcgtgcagctgagccagcagagcgccaaggacttcctgcacgtgctgaacctgaacaagcgctgcgacaccagcaagcaccgcgtgctggtggtgagcgtgtgcccccagagcctgccctacttcgccgccaagttcaacctgagcgtgaccgacgccagccgccgcctgtgcggcttcctgaagagcctgggcgtgcactacgtgttcgacaccaccatcgccgccgacttcagcatcctggagagccagaaggagttcgtgcgccgctaccaccagcacagcgaggagcagcgcgagctgcccatgctgaccagcgcctgccccggctgggtgcgctacgccgagcgcgtgctgggccgccccatcatcccctacctgtgcaccgccaagagcccccagcaggtgatgggcagcctggtgaaggactacttcgcccgccagcagaacctgagccccgagaagatcttccacgtggtggtggccccctgctacgacaagaagctggaggccctgcgcgagggcctgagcaccaccctgaacggcgcccgcggcaccgactgcgtgctgaccagcggcgagatcgcccagatcatggagcagagcgacctgagcgtgaaggacatcgccgtggacaccctgttcggcgacatgaaggaggtggccgtgcagcgccacgacggcgtgagcagcgacggccacctggcccacgtgttccgccacgccgccaaggagctgttcggcgagcacgtggaggagatcacctaccgcgccctgcgcaacaaggacttccacgaggtgaccctggagaagaacggcgaggtgctgctgcgcttcgccgccgcctacggcttccgcaacatccagaacatgatccagaagctgaagaagggcaagctgccctaccacttcgtggaggtgctggcctgcccccgcggctgcctgaacggccgcggccaggcccagaccgaggacggccacaccgaccgcgccctgctgcagcagatggagggcatctacagcggcatccccgtgcgcccccccgagagcagcacccacgtgcaggagctgtaccaggagtggctggagggcaccgagagccccaaggtgcaggaggtgctgcacaccagctaccagagcctggagccctgcaccgacggcctggacatcaagtggtaa

SEQ ID NO: 256 - DNA, 1374 bp, Caenorhabditis elegans
atggaggacagcggcttcagcggcgtggtgcgcctgagcaacgtgagcgacttcatcgcccccaacctggactgcatcatccccctggagacccgcaccgtggagaagaagaaggaggagagccaggtgaacatccgcaccaagaagcccaaggacaaggagagcagcaagaccgaggagaagaagagcgtgaagatcagcctggccgactgcctggcctgcagcggctgcatcaccagcgccgagaccgtgctggtggaggagcagagcttcggccgcgtgtacgagggcatccagaacagcaagctgagcgtggtgaccgtgagcccccaggccatcaccagcatcgccgtgaagatcggcaagagcaccaacgaggtggccaagatcatcgccagcttcttccgccgcctgggcgtgaagtacgtgatcgacagcagcttcgcccgcaagttcgcccacagcctgatctacgaggagctgagcaccacccccagcaccagccgccccctgctgagcagcgcctgccccggcttcgtgtgctacgccgagaagagccacggcgagctgctgatccccaagatcagcaagatccgcagcccccaggccatcagcggcgccatcatcaagggcttcctggccaagcgcgagggcctgagcccctgcgacgtgttccacgccgccgtgatgccctgcttcgacaagaagctggaggccagccgcgagcagttcaaggtggacggcaccgacgtgcgcgagaccgactgcgtgatcagcaccgccgagctgctggaggagatcatcaagctggagaacgacgaggccggcgacgtggagaaccgcagcgaggaggagcagtggctgagcgccctgagcaagggcagcgtgatcggcgacgacggcggcgccagcggcggctacgccgaccgcatcgtgcgcgacttcgtgctggagaacggcggcggcatcgtgaagaccagcaagctgaacaagaacatgttcagcaccaccgtggagagcgaggccggcgagatcctgctgcgcgtggccaaggtgtacggcttccgcaacgtgcagaacctggtgcgcaagatgaagaccaagaaggagaagaccgactacgtggagatcatggcctgccccggcggctgcgccaacggcggcggccagatccgctacgagaccatggacgagcgcgaggagaagctgatcaaggtggaggccctgtacgaggacctgccccgccaggacgacgaggagacctggatcaaggtgcgcgaggagtgggagaagctggacaagaactaccgcaacctgctgttcaccgactaccgccccgtggagaccaacgtggcccaggtgctgaagtggtaa

SEQ ID NO: 257 - DNA, 1389 bp, Mus musculus
atgaagtgcgagcactgcacccgcaaggagtgcagcaagaagagcaagaccgacgaccaggagaacgtgagcagcgacggcgcccagcccagcgacggcgccagccccgccaaggagagcgaggagaagggcgagttccacaagctggccgacgccaagatcttcctgagcgactgcctggcctgcgacagctgcgtgaccgtggaggagggcgtgcagctgagccagcagagcgccaaggacttcctgcacgtgctgaacctgaacaagcgctgcgacaccagcaagcaccgcgtgctggtggtgagcgtgtgcccccagagcctgccctacttcgccgccaagttcaacctgagcgtgaccgacgccagccgccgcctgtgcggcttcctgaagagcctgggcgtgcactacgtgttcgacaccaccatcgccgccgacttcagcatcctggagagccagaaggagttcgtgcgccgctaccaccagcacagcgaggagcagcgcgagctgcccatgctgaccagcgcctgccccggctgggtgcgctacgccgagcgcgtgctgggccgccccatcatcccctacctgtgcaccgccaagagcccccagcaggtgatgggcagcctggtgaaggactacttcgcccgccagcagaacctgagccccgagaagatcttccacgtggtggtggccccctgctacgacaagaagctggaggccctgcgcgagggcctgagcaccaccctgaacggcgcccgcggcaccgactgcgtgctgaccagcggcgagatcgcccagatcatggagcagagcgacctgagcgtgaaggacatcgccgtggacaccctgttcggcgacatgaaggaggtggccgtgcagcgccacgacggcgtgagcagcgacggccacctggcccacgtgttccgccacgccgccaaggagctgttcggcgagcacgtggaggagatcacctaccgcgccctgcgcaacaaggacttccacgaggtgaccctggagaagaacggcgaggtgctgctgcgcttcgccgccgcctacggcttccgcaacatccagaacatgatccagaagctgaagaagggcaagctgccctaccacttcgtggaggtgctggcctgcccccgcggctgcctgaacggccgcggccaggcccagaccgaggacggccacaccgaccgcgccctgctgcagcagatggagggcatctacagcggcatccccgtgcgcccccccgagagcagcacccacgtgcaggagctgtaccaggagtggctggagggcaccgagagccccaaggtgcaggaggtgctgcacaccagctaccagagcctggagccctgcaccgacggcctggacatcaagtggtaa

SEQ ID NO: 258 - DNA, 1431 bp, Anopheles gambiae
agccgcttcagcagcgccctgcagctgaccgacctggacgacttcatcacccccagccaggagtgcatcaagcccgtgaagatcgagaccagcaagagcaagaccggcgccaagatcaccatccaggaggacggcagctacgtgcaggagagcagcagcggcatccagaagctggagaaggtggagatcaccctggccgactgcctggcctgcagcggctgcatcaccagcgccgagggcgtgctgatcagccagcagagccaggaggagctgctgcgcgtgatgaacgccaacaacctggccaagctgaacaaccagcgcgacgagatcaagttcgtggtgttcaccgtgagccagcagcccatcctgagcctggcccgcaagtacaacctgacccccgaggacaccttcgagcacatcgccggctacttcaagaagctgggcgccgacatggtggtggacaccaagatcgccgacgacctggccctgatcgagtgccgcaacgagttcatcgagcgctacaacaccaaccgcaagctgctgcccatgctggccagcagctgccccggctgggtgtgctacgccgagaagacccacggcaacttcatcctgccctacatcgccaccacccgcagcccccagcagatcatgggcgtgctggtgaagcagtacctggccaagcagctgcagaccaccggcgaccgcatctaccacgtgaccgtgatgccctgctacgacaagaagctggaggccagccgcgaggacttcttcagcgaggtggagaacagccgcgacgtggactgcgtgatcaccagcatcgagatcgagcagatgctgaacagcctggacctgcccagcctgcagctggtggagcgctgcgccatcgactggccctggcccaccgtgcgccccagcgccttcgtgtggggccacgagagcagcggcagcggcggctacgccgagtacatcttcaagtacgccgcccgcaagctgttcaacgtgcagctggacaccgtggccttcaagcccctgcgcaacaacgacatgcgcgaggccgtgctggagcagaacggccaggtgctgatgcgcttcgccatcgccaacggcttccgcaacatccagaacatggtgcagaagctgaagcgcggcaagagcacctacgactacgtggagatcatggcctgccccagcggctgcctgaacggcggcgcccagatccgccccgaggagggccgcgccgcccgcgagctgaccgccgagctggagtgcatgtaccgcagcctgccccagagcacccccgagaacgactgcgtgcagaccatgtacgccaccttcttcgacagcgagggcgacctgaacaagcgccagagcctgctgcacaccagctaccaccagatcgagaagatcaacagcgccctgaacatcaagtgg

SEQ ID NO: 259 - DNA, 357 bp, Neocallimastix sp.
atcatgttcgccgagaagaacttccccgacatggtgaacaacctgagcaccaccaagagccccatgcagatgctgagcagcctgaccaagggctactgggccaaggacatcaagaagatcaaccccaaggacgtggtgaacgtggccatcatgccctgcaccgccaagaagcaggagaaggaccgccccggcatgaagaccgacgagggcgacaaggtgaccgacttcgtgctgaccacccgcgagctgggcatgatgctgcgccaggccaacatcgaccccaccaagctgcccggcaccaagttcgacaaggtgatgggcgagagcaccggcgccgccgtgatcttcggcgccacc

SEQ ID NO: 260 - DNA, 357 bp, Nyctotherus ovalis
atcatcttcatggagaagaactaccccgacatgctgagccacctgagcacctgcaagagcccccagggcatgctgggcgccctgatcaagggctactgggccaagaaggtgaagaaggtggaccccaaggacgtggtgagcgtgagcatcatgccctgcaccgccaagaaggccgagaaggagcgcccccagctgcgcggcgacgagggcttcaaggacgtggactacgtgctgaccacccgcgagctggccaagatgctgaagcagagcaacatcgacctgggcaaggtggagcccacccccttcgacgccgtgatgagcgagggcaccggcgccgccgtgatcttcggcgtgacc

SEQ ID NO: 261 - DNA, 1473 bp, Clostridium perfringens
atggccatcaaggacgccaacaagcagtacatcaagttcgacaccgccgtgcaggtgctgaagtacgaggtgctgaagcgcatcgccgagaaggagttcgacggcaccctggacaaggagaagctgaacatcgccaaggagatcgtggacgacctgaagcccaacgtgcgctgctgcatctacaaggagcgcgccatcgtggaggagcgcatgaagctggccctgggcggccacgagaaccgcgagaacatgatcgaggtgatcgacatcgcctgcgacgagtgccccgtgaaccgcttcatcgtgaccgacgcctgccgcggctgcctggccaagaagtgccgcgacagctgcaacttcggcgccatcagcttcgacaaccgcaagtgcaagatcgactacgagaagtgcaaggagtgcggcaagtgcaaggaggtgtgcccctacaacgccatcgccgaggtgaagcgcccctgcatgcgcgcctgcatccccaaggccctgagctacgacgtggacagcaagaaggccgtgatcgacgacagcaagtgcatccagtgcggcgcctgcgtggtggactgccccttcggcgccatcatggacaagagctacctggtggacgtgatccgcctgctgaaggacgagaagaaggtgtacgccatcgtggcccccgccatcagcagccagttcaaccacagcaagatcggcaaggtgatcaccgccatcaagaagctgggcttcgaggacgtgttcgaggccgccctgggcgccgacctggtggccgtgcacgagtgcaacgagttcaaggagaagggcgagctggacttcatgaccaccagctgctgccccgccttcgtgagctacatcgagaagaactaccccgagctgaaggagtgcatcagcaacaccgtgagccccatggtggccatggcccgcctgatcaagagccagaacaaggacgtgaagaccgtgttcatcggcccctgcatcgccaagaagaccgaggccaagcgcaacgaggtgagcggcgacgtggactacgtgctgaccttcgaggagctgctggccctgctggacagccgcaacatcaagatcgacgagtgcgaggagagcgacaccaagcacggcagcttctacggccgcctgttcgcccgcagcggcggcgtgaccgagagcgtgaagcacctgatcgacagcgagggcatcaaggtggacttccgccccatcctgggcgacggcatcaaggactgcgacatcaagctgcgcctggccaagctgaagcgcgcccagggcaacttcctggagggcatggcctgcaagggcggctgcatcaacggccccggcagcctgaaccacgacatcaagaacagcaaggaggtggacaagtacggcgagctgagcagcagcgagaagatcaaggacaccctggccgacatcaagttcgaggacctgaacctgagcaagaacgagtaa

SEQ ID NO: 262 - DNA, 1371 bp, Homo sapiens
atgaagtgcgagcactgcacccgcaaggagtgcagcaagaagaccaagaccgacgaccaggagaacgtgagcgccgacgcccccagccccgcccaggagaacggcgagaagggcgagttccacaagctggccgacgccaagatcttcctgagcgactgcctggcctgcgacagctgcatgaccgccgaggagggcgtgcagctgagccagcagaacgccaaggacttcttccgcgtgctgaacctgaacaagaagtgcgacaccagcaagcacaaggtgctggtggtgagcgtgtgcccccagagcctgccctacttcgccgccaagttcaacctgagcgtgaccgacgccagccgccgcctgtgcggcttcctgaagagcctgggcgtgcactacgtgttcgacaccaccatcgccgccgacttcagcatcctggagagccagaaggagttcgtgcgccgctaccgccagcacagcgaggaggagcgcaccctgcccatgctgaccagcgcctgccccggctgggtgcgctacgccgagcgcgtgctgggccgccccatcaccgcccacctgtgcaccgccaagagcccccagcaggtgatgggcagcctggtgaaggactacttcgcccgccagcagaacctgagccccgagaagatcttccacgtgatcgtggccccctgctacgacaagaagctggaggccctgcaggagagcctgccccccgccctgcacggcagccgcggcgccgactgcgtgctgaccagcggcgagatcgcccagatcatggagcagggcgacctgagcgtgcgcgacgccgccgtggacaccctgttcggcgacctgaaggaggacaaggtgacccgccacgacggcgccagcagcgacggccacctggcccacatcttccgccacgccgccaaggagctgttcaacgaggacgtggaggaggtgacctaccgcgccctgcgcaacaaggacttccaggaggtgaccctggagaagaacggcgaggtggtgctgcgcttcgccgccgcctacggcttccgcaacatccagaacatgatcctgaagctgaagaagggcaagttccccttccacttcgtggaggtgctggcctgcgccggcggctgcctgaacggccgcggccaggcccagacccccgacggccacgccgacaaggccctgctgcgccagatggagggcatctacgccgacatccccgtgcgccgccccgagagcagcgcccacgtgcaggagctgtaccaggagtggctggagggcatcaacagccccaaggcccgcgaggtgctgcacaccacctaccagagccaggagcgcggcacccacagcctggacatcaagtggtaa

SEQ ID NO: 263 - DNA, 1227 bp, Homo sapiens
atgaagtgcgagcactgcacccgcaaggagtgcagcaagaagaccaagaccgacgaccaggagaacgtgagcgccgacgcccccagccccgcccaggagaacggcgagaagtgcgacaccagcaagcacaaggtgctggtggtgagcgtgtgcccccagagcctgccctacttcgccgccaagttcaacctgagcgtgaccgacgccagccgccgcctgtgcggcttcctgaagagcctgggcgtgcactacgtgttcgacaccaccatcgccgccgacttcagcatcctggagagccagaaggagttcgtgcgccgctaccgccagcacagcgaggaggagcgcaccctgcccatgctgaccagcgcctgccccggctgggtgcgctacgccgagcgcgtgctgggccgccccatcaccgcccacctgtgcaccgccaagagcccccagcaggtgatgggcagcctggtgaaggactacttcgcccgccagcagaacctgagccccgagaagatcttccacgtgatcgtggccccctgctacgacaagaagctggaggccctgcaggagagcctgccccccgccctgcacggcagccgcggcgccgactgcgtgctgaccagcggcgagatcgcccagatcatggagcagggcgacctgagcgtgcgcgacgccgccgtggacaccctgttcggcgacctgaaggaggacaaggtgacccgccacgacggcgccagcagcgacggccacctggcccacatcttccgccacgccgccaaggagctgttcaacgaggacgtggaggaggtgacctaccgcgccctgcgcaacaaggacttccaggaggtgaccctggagaagaacggcgaggtggtgctgcgcttcgccgccgcctacggcttccgcaacatccagaacatgatcctgaagctgaagaagggcaagttccccttccacttcgtggaggtgctggcctgcgccggcggctgcctgaacggccgcggccaggcccagacccccgacggccacgccgacaaggccctgctgcgccagatggagggcatctacgccgacatccccgtgcgccgccccgagagcagcgcccacgtgcaggagctgtaccaggagtggctggagggcatcaacagccccaaggcccgcgaggtgctgcacaccacctaccagagccaggagcgcggcacccacagcctggacatcaagtggtaa

SEQ ID NO: 264 - DNA, 1509 bp, Homo sapiens
atgaagtgcgagcactgcacccgcaaggagtgcagcaagaagaccaagaccgacgaccaggagaacgtgagcgccgacgcccccagccccgcccaggagaacggcgagaagggcgagttccacaagctggccgacgccaagatcttcctgagcgactgcctggcctgcgacagctgcatgaccgccgaggagggcgtgcagctgagccagcagaacgccaaggacttcttccgcgtgctgaacctgaacaagaagtgcgacaccagcaagcacaaggtgctggtggtgagcgtgtgcccccagagcctgccctacttcgccgccaagttcaacctgagcgtgaccgacgccagccgccgcctgtgcggcttcctgaagagcctgggcgtgcactacgtgttcgacaccaccatcgccgccgacttcagcatcctggagagccagaaggagttcgtgcgccgctaccgccagcacagcgaggaggagcgcaccctgcccatgctgaccagcgcctgccccggctgggtgcgctacgccgagcgcgtgctgggccgccccatcaccgcccacctgtgcaccgccaagagcccccagcaggtgatgggcagcctggtgaaggactacttcgcccgccagcagaacctgagccccgagaagatcttccacgtgatcgtggccccctgctacgacaagaagctggaggccctgcaggagagcctgccccccgccctgcacggcagccgcggcgccgactgcgtgctgaccagcgagatcagccaggcctggtggtgcacccccgtgatcaccgccacccgcgaggccgccgcccgcgagagcctggagcccggccgccagcgcctgcagcgcgacaagatcgcccccctggacagcagcctgggcggcggcggcgagatcgcccagatcatggagcagggcgacctgagcgtgcgcgacgccgccgtggacaccctgttcggcgacctgaaggaggacaaggtgacccgccacgacggcgccagcagcgacggccacctggcccacatcttccgccacgccgccaaggagctgttcaacgaggacgtggaggaggtgacctaccgcgccctgcgcaacaaggacttccaggaggtgaccctggagaagaacggcgaggtggtgctgcgcttcgccgccgcctacggcttccgcaacatccagaacatgatcctgaagctgaagaagggcaagttccccttccacttcgtggaggtgctggcctgcgccggcggctgcctgaacggccgcggccaggcccagacccccgacggccacgccgacaaggccctgctgcgccagatggagggcatctacgccgacatccccgtgcgccgccccgagagcagcgcccacgtgcaggagctgtaccaggagtggctggagggcatcaacagccccaaggcccgcgaggtgctgcacaccacctaccagagccaggagcgcggcacccacagcctggacatcaagtggtaa

SEQ ID NO: 265 - DNA, 1347 bp, Clostridium tetani
atgcacaacgactaccgcgagatcttcaagcgcctgagcaagagctactacgacgacaccttcgagaaggaggtggagaacatcctgagcagccacagcatggaccgcgagaagctggccaagatcatcagcatcctgtgcggcgtgaacatcgagcacagcgagaactacatcagcaacctgaagaacgccatcaagaactacaccgccagcgccgagaaggtggtgaccaagctgccctgcagcacccagtgcgccaaggacggcgacatcatctgcgagaagagctgccccgtgaacgccatcttccgcgaccccaacgacaacaacatctacatcaacgacgagctgtgcctggactgcggcctgtgcgtgcgcaactgccccagcggcagcatcctggacaagaaggagttcatccccctggccgagctgctgaagagcgagagcatcgtgatcgccgccgtggcccccgccatcatgggccagttcggcgagaacaccaccatcaaccagctgcgcaccgccttcaagaagctgggcttcaccgacatggtggaggtggccttcttcgccgacatgctgaccctgaaggaggccgtggagtacgaccacttcgtgaaggacgagcaggacttcatgatcaccagctgctgctgccccatgtgggtgggcatgctgaagaaggtgtacaacgacctggtgaagtacgtgagccccagcgtgagccccatgatcgccgccggccgcgtgctgaagctgctgaaccccaactgcaaggtggtgttcgtgggcccctgcatcgccaagaaggccgaggcccgcgagaaggacctgctgggcgacatcgacttcgtgctgaccttcaccgagctgcgcgacatcttcgacgtgttcgacatccagcccgagaacctggaggaggacttcagcagcgagtacgccagcaagggcggccgcctgtacgcccgcaccggcggcgtgagcatcgccgtgagcgaggccatcgagaagctgttccccaacaagtacaagttcctgaagaccatccaggccgacggcgtgaagggctgcaagagcctgctggacaagatcaagcaggaggacatcagcgccaacttcgtggagggcatgggctgcgtgggcggctgcgtgggcggccccaaggtgatcatcgaccccagcgagggccgcaacgccgtgaacaacttcgccgagaacagcagcatcaaggtgagcgtggacagcaactgcatgaacgacatcctgagcaagatcaacatcaacagcgtggaggacttcaaggacaaggacaagatcagcatcttcgagcgcgagttcaagtaa

SEQ ID NO: 266 - DNA, 1377 bp, Desulfovibrio desulfuricans
atgtacttccgcacctacgacaacaccatcaacttcgagatcatggtgcgcatcgccaaggccttccacggcgacagcttcgaggagcaggtggcccgcatccccctggagatgcgcccccgcaaggcccacagcagccgctgctgcatctaccgcgaccgcgccatcatccgctaccgctgcatggccatgctgggctacgccatcgaggacgagaccgacgagctgaccagcctgagccagtacgccaagggcgccctggagcgcgacagcatccagggcagcatgctgaccttcatcgacgaggcctgcaacggctgcgtgcgcacccactacgaggccaccagcgcctgccgcggctgcctggccgaggcctgcgtgcagcactgccccaaggacgccgtgcgcatcgtggacggcaagagccgcatcgaccccgacaagtgcgtgcagtgcggcaagtgcatgaacgtgtgcccctaccacgccatcgtgcagatccccatcccctgcgaggagagctgccccaccggcgccatcagcaaggacgagtgcggcaagcaggtgatcgactacgaccgctgcatcttctgcggcaagtgcatggccgcctgccccttcgccgccgtgctggagaagagccagatgatcgacgtgctgcgccgcatccgcgagggccgcaaggtggtggccatcgtggcccccgccatcgccggccaggtgcaggcccccatgagccgcctggccaccgccctgcgccagctgggcttcgccgacgtggccgaggtggccagcggcgccgacaccaccgcccgcctggaggccgacgagttcgtggagcgcatggagcacggcgccgccttcatgaccagcagctgctgccccgcctacacccagctggtggacaagcacctgcccgagctggcccccttcgtgagcgacacccgcacccccatgcactacaccgccgccatggtgaaggaccacgaccccgacatggtgaccgtgttcatcggcccctgcgtggccaagcgcaacgagggcaagcacgacgagctggtggaccacgtgctgaccttccaggagatggtggccatgctgaccgccgccggcatcagcgtggacgcctgcgaggacggccgcttcatgttccccgccatgcgcgagggccgcagcttccccgtgagcggcggcgtgaccgccggcgtgcaggcccacatcggcacccgcgccgaggtgcgccccctgagcgtggacggcctgaacaagaagaccttccgccagctgaagacctgggccaagaagggctgcgagggcaacttcgtggaggtgatgggctgccagggcggctgcgtggccggccccgccatcgtgatg

SEQ ID NO: 267 - DNA, 1485 bp, Clostridium tetani
atgatcgtgttcgagaaccagctgaagaagctgaagtacctggtgctgaaggaggtggccaagatgaccctggaggaccgcctgggcgaggaggacatcgagcgcatcagcttcgacatcatcaagggcgacaaggccgagtaccgctgctgcgtgtacaaggagcgcgccatcgtgtacgagcgcgccaagctggccaccggctgcctgcccaacggccaggtggccgaggagttcgtgcacgtggaggacgacgaccagatcatctacgtgatcgacgccgcctgcgacaagtgccccatcaacaagtacgtggtgaccgaggcctgccgcggctgcctgcagcacaagtgcatggaggtgtgccccgccggcagcatcaaccgcgccgccggcaaggcctacatcaaccacgagacctgcaaggagtgcggcctgtgcgagagcgcctgcccctacaacgccatcgccgaggtgatgcgcccctgccgccgcgcctgccccaccggcgccctgcagatgaacctggaggacaacaaggccaccatcaacaaggaggactgcatcaactgcggcagctgcatgagcgtgtgccccttcggcgccatcagcgacaagagctacatcgtggacatcaccaaggccctgaagaacaacaagaaggtgtacgccatggtggcccccgccatcaccggccagttcggcaaggacgtgagcgtgggcaagatgaagaacgccttcaaggccatgggcttcgaggacatgctggaggtggcctgcggcgccgacgccgtggccgcccacgagagcgaggagttcatcgagcgcctggagagcggcaagaagtacatgaccaccagctgctgccccggcttcctgggctacatcgagaagaagttccccgaccagctggagaacgtgagcaacaccgtgagccccatggtggccatcggccgcatgatcaagaaggagtacgaggacagcgtggtggtgttcgtgggcccctgcaccgccaagaaggccgagatcaagcgcaagggcatcaaggacgccgtggactacgtgatgaccttcgaggagatcgccgccctgatgggcgccttcgagatcgaccccgccgagtgcgaggaggaggacatcaacgacggcagcaactacggccgcggcttcgcccagggcggcggcgtggtgagcgccatccagaactgcatcaaggacaaggagggcatcaagttcaaccccctgcgcgtgagcggccccgaccagatcaagcgcgccatgatcatggccaaggtgggcaagctgagcgagaacttcatcgagggcatgatgtgcgagggcggctgcatcggcggccccgccaccatggtgagcgccgtgaaggccaaggcccccctgatgaagttcagcaagagcagcaccatcaaggacgtgaaggacaacgaggtgctggacaagtacaaggacatcaacatggagcgctaa

SEQ ID NO: 268 - DNA, 612 bp, Arabidopsis thaliana
atggacctgatcaagctgaagggcgtggacttcaaggacctggaggagagccccctggaccgcgtgctgaccaacgtgaccgaggagggcgacctgtacggcgtggccggcagcagcggcggctacgccgagaccatcttccgccacgccgccaaggccctgttcggccagaccatcgagggccccctggagttcaagaccctgcgcaacagcgacttccgcgaggtgaccctgcagctggagggcaagaccgtgctgaagttcgccctgtgctacggcttccagaacctgcagaacatcgtgcgccgcgtgaagacccgcaagtgcgactaccagtacgtggagatcatggcctgccccgccggctgcctgaacggcggcggccagatcaagcccaagaccggccagagccagaaggagctgatccacagcctggaggccacctacatgaacgacaccaccctgaacaccgacccctaccagaaccccaccgccaagcgcctgttcgaggagtggctgaaggagcccggcagcaacgaggccaagaagtacctgcacacccagtaccaccccgtggtgaagagcgtgaccagccagctgaacaactggtaa

SEQ ID NO: 269 - DNA, 1476 bp, Saccharomyces cerevisiae
atgagcgccctgctgagcgagagcgacctgaacgacttcatcagccccgccctggcctgcgtgaagcccacccaggtgagcggcggcaagaaggacaacgtgaacatgaacggcgagtacgaggtgagcaccgagcccgaccagctggagaaggtgagcatcaccctgagcgactgcctggcctgcagcggctgcatcaccagcagcgaggagatcctgctgagcagccagagccacagcgtgttcctgaagaactggggcaagctgagccagcagcaggacaagttcctggtggtgagcgtgagcccccagtgccgcctgagcctggcccagtactacggcctgaccctggaggccgccgacctgtgcctgatgaacttcttccagaagcacttccagtgcaagtacatggtgggcaccgagatgggccgcatcatcagcatcagcaagaccgtggagaagatcatcgcccacaagaagcagaaggagaacaccggcgccgaccgcaagcccctgctgagcgccgtgtgccccggcttcctgatctacaccgagaagaccaagccccagctggtgcccatgctgctgaacgtgaagagcccccagcagatcaccggcagcctgatccgcgccaccttcgagagcctggccatcgcccgcgagagcttctaccacctgagcctgatgccctgcttcgacaagaagctggaggccagccgccccgagagcctggacgacggcatcgactgcgtgatcaccccccgcgagatcgtgaccatgctgcaggagctgaacctggacttcaagagcttcctgaccgaggacaccagcctgtacggccgcctgagcccccccggctgggacccccgcgtgcactgggccagcaacctgggcggcacctgcggcggctacgcctaccagtacgtgaccgccgtgcagcgcctgcaccccggcagccagatgatcgtgctggagggccgcaacagcgacatcgtggagtaccgcctgctgcacgacgaccgcatcatcgccgccgccagcgagctgagcggcttccgcaacatccagaacctggtgcgcaagctgaccagcggcagcggcagcgagcgcaagcgcaacatcaccgccctgcgcaagcgccgcaccggccccaaggccaacagccgcgagatggccgccgccaccgccgccaccgccgacccctaccacagcgactacatcgaggtgaacgcctgccccggcgcctgcatgaacggcggcggcctgctgaacggcgagcagaacagcctgaagcgcaagcagctggtgcagaccctgaacaagcgccacggcgaggagctggccatggtggaccccctgaccctgggccccaagctggaggaggccgccgcccgccccctgagcctggagtacgtgttcgcccccgtgaagcaggccgtggagaaggacctggtgagcgtgggcagcacctggtaa

SEQ ID NO: 270 - DNA, 840 bp, Desulfitobaccerium hafniense
atgaccatgggccagctgcgcgccgccctgaagcacctgggcttctacggcatgatcgaggtggccctgttcgccgacgtgctgagcctgaaggaggccctggagttcgacaagcacgtgcagaccgacaaggacttcgtgctgaccagctgctgctgccccatctgggtgggcatggtgaagcgcgtgtacgacaccctggtgccccacatcagccccagcgtgagccccatggtggcctgcggccgcggcatcaagcgcctgcaccccgacgccaagaccgtgttcatcggcccctgcatcgccaagaaggccgaggccaaggagcccgacatccgcgacgccgtggacgccgtgctgaccttccacgagctgaagcagatcttcgaggccaccgacatcgagcccagcgagatggaggacatccccagcgagcacagcagcaccagcggccgcatctacgcccgcaccggcggcgtgagcaagagcatcagcgacaccctgaaccgcatccgccccgacaagcccgtgaagatcaagagcatccaggccaacggcatcaaggagtgcaaggccctgctgaacgacatcatgaacaacgagatcaaggccaacttctacgagggcatgggctgccccggcggctgcgtgggcggccccaaggccatcgtggacgtggaccgcggcaccgagttcgtgaacaagtacggcgccgaggccgacgccctgacccccgccgacaaccagcacgtgctggagctgctgaagcagctgggcatcgacagcgtggaggagctgctgggcggcgagagcgccgccatcttccagcgcgacttctaa

SEQ ID NO: 271 - DNA, 1350 bp, Clostridium perfringens
atgaacaagaagtacaacagcctgttcaaggagctgatcagcagctactacagcgaggacaacttcgacgagaagctgaacgacatcgtgaagaacaacttcaacagcaaggaggacgccatcgaggtgctgagcagcctgtgcggcgtggacatcgacaagaacagcgacaacatcgcctacgacatccgcaaggccatcaccacccacaagatcaagaagaacatcgtggacaaggtgagcgtgtgcaccaagaactgcagcaaggagagcaagggcaagtgccagagcctgtgccccttcgacgccatcctgaccgaccccatcgacaacagcaagtacatcgaccccaacctgtgccagaactgcggcatctgcgtgcaggtgtgcgagagcggccacttcctggaccgcatcgagctgctgcccatcatcgacctgatcaagaacaacgagaccgtgatcgccgccgtggcccccgccatcgccggccagttcggcgagaacgtgagcctggacatgctgcgcgaggccttcatcaagatcggcttcagcgacatgatcgaggtggccttcgccgccgacatgctgagcatcaaggaggccgtggagttcaaccaccacgtggagaagaccggcgacatcctgatcaccagctgctgctgccccatgtgggtggccatgctgcgcaagtgctacaaggacctggtgaaggacgtgagccccagcgtgagccccatgatcgccgccggccgcgtgatcaagaagctgaacaaggacgccaaggtggtgttcatcggcccctgcatcgccaagaaggccgaggcccgcgagaaggacctggtgggcgccatcgactacgtgctgaccttcgaggagctgaacggcatcttcgaggccctgaagatcgaccccagcagcatgaagggcgtgcccagcatcgagtacaccagccgcggcggccgcctgtacgcccgcaccggcggcgtgagcgaggccatcaacgacgtggtgaaggagctgtaccccgacaaggccaagatcttcaaggccgtgcaggccaacggcgtgaaggagtgcaaggagctgctgaacaaggtgcagagcggcgagctgaaggccaacttcatcgagggcatgggctgcgtgggcggctgcgtgggcggccccaagcgcatcgtggaccccagcatcggcaagaagcacgtggacgaggtggcctacaacagccccatcaaggtggccacccacagccacaccatggacgaggtgctgctgcgcctgggcatcaacagcctgaagagcttcgaggacaaggagaagatcagcatcttcgagcgcgagttctaa

SEQ ID NO: 272 - DNA, 1077 bp, Desulfitobaccerium hafniense
atggcccagagcgagatcatgaagatccgccgccaggtgctgaagagcgccctggactgggtgagccacgaccagaaccgcaaggaccgcgccaccctggcccgccagatcatccccgacggcaccccccgctaccgctgctgcatccacaaggagcgcgccgtgatcgaggagcgcctgaaggccgtgctggagcccgacgagggccccatcgtgcgcgtgctgaaggagggctgcaacggctgcgagatgcaccgctacagcgtgaccgaccactgccagaactgcgtgggccacttctgcttcaccaactgccccaagaaggccatcctgttcatcaacaacaaggccttcatcgaccagacccgctgcgtggagtgcggcctgtgcgcccgcaactgcccctaccacgccatcatcgagtaccgccgcccctgcgaggacagctgccccaccaaggccatcagcgtgcgcgaggaccgcatcgccagcatcgccgaggcccactgcaccagctgcggcaagtgcatcatcagctgccccttcggcgccgtggccgagagcagccagctgatccacctgttcgaggccgtgcgcaaccccgagcacaagatctacgccgtgatcgcccccgccttcgtgggccagttcggccgcaaggtgagccccggccaggtgaagagcgccctgctgaagctgggcttccaggacgtgctggaggccgccctgggcgccgaccgcaccatcgagctggaggcccgcgagtacgacgagcgcctggcccacggcgaggagttcatgaccagcagctgctgccccgcctacgtgagcgccgtgatcaaggagaagcccgacctgttccaccacatcagcagcaccctgagccccatggcccaggtggcccacatcctgaaggagaaggaccccgaggccaagatcgccttcatcggcccctgcgtggccaagaaggaggagggcaagcgccccgagaccaaggtggacttcgtgctgaccttcgaggagctgatggtgtggctggactacgccggcatcaaccccgccgaggagagcgagcag

SEQ ID NO: 273 - DNA, 2373 bp, Geobaccer metallireducens
gtgtgccactggctgcaccgcgaggccggcctggtgtacgaccccgccgtggaccaggccatcaaccgcgtgagcggcctgaccctgagcgccggccgcaccatggagcccatcatcaccgtgaaggagaagtgccgcaagtgctactgctgcgtgcgcagctgccccgtgaaggccatcaaggtggccaagagctacaccgagatcatcgtggaccgctgcatcggctgcggcaactgcctgagcaactgcccccagcaggccaagatggtggccgacaaggtgggcgtgaccgagaagctgctgagcagcggcgaggaggtgatcgccgtgctgggcagcagcttccccgccttcttccacaacgtgacccccggccagctggtggccggcctgcgcaagatcggcttcgccgaggtgcacgagggcagctacggcgccgagctgatcgccgacgactacgcccgcatcaccagcgagaagggccacccccgcatcagcagccactgccccgccatcgtggacctgatcgagcgccactaccccaagctggtgggcaacctggtgcccgtggtgagccccatggtggccatgggccgctacctgaagggcaccctgggccagcacgtgcgcgtggtgtacatcagcagctgcgtggccaacaagctggagacccagacccaggagacccgcggcgccgtggacatcgtgctgacctaccgcgagctggagggcatcttccgcagccgccagatcgccctgcccgccctggccgacgagcccctggacggcatccgccccggcgccggccgcctgttccccatcgccgacggcaccttccgcgccttcggcatccccttcgaccccctggacaccgagatcgtggccgcctgcggcgaggtgaacgtgatgggcatcatcaacgacctggccgccggccgcatcagcccccgcatcgccgacctgcgcttctgctacgacggctgcatcggcggccccggccgcaaccgcgccctgaccgagttctaccgccgcaaccgcgtgatcgcccacttcaagcaggaggtgccctgccgcaccgtgcccaacagcctgctggaggccggccgcgtgagcttcggccgcagcttcgccagcaagtacgccaagctggaggcccccaaggccaacgacgtgcgcaagatcctgaacgccaccaacaagttcaccgtgaaggacgagctgaactgccgcgcctgcggctaccgcacctgccgcgagtacgccgtggccgtgttccagggcctggccgagatcgagatgtgcctgccctacaacctgcagcagctggaggaggaccgcggccgcctgatccagaagtacgagctggcccgccgcgagctggagcgcgagtacggcgacgagttcatcgtgggcaacgaccgcaagaccctggacgtgctgggcctgatcaagcaggtgggccccacccccaccaccgtgctgatccgcggcgagagcggcaccggcaaggagctgaccgcccgcgccatccaccgctacagcaagcgcaacgacaagcccctggtgaccgtgaactgcaccaccatcaccgacagcctgctggagagcgagctgttcggccacaagcgcggcgccttcaccggcgccgtggccgacaagaagggcctgttcgaggccgccgacggcggcaccatcttcctggacgagatcggcgacatcacccccaagctgcaggccgagctgctgcgcgtgctggacatgggcgaggtgcgccccgtgggcggcaccgccgccaagaaggtggacgtgcgcctgatcgccgccaccaacaagaacctggagcagggcgtgcgcgagggctggttccgcgaggacctgtactaccgcctgaacgtgttcaccatcaccatgccccccctgcgcagccgcgtggagagcatccccatcctggtgcaccacttcatggacaaggccagcaccaagctgaacaagcgcatggtgggcatcgaggaccgcgccgtgaaggccctgaccaagtacccctggcccggcaacatccgcgagatgcagaacgtgatcgagcgcgccgccgtgctgacccacgacggcgtgatccgcgtggagaacttccccctggccctgagcgagggcctggaggagggcttcgccaccggcctggacatccacgccgccagcttccgcagcgagcgcgagcagcacatgggcaagctggagaagaagctgatccagcgctacctgaccgaggccaacggcaacatcagccgcgccgccaagctggccaacatcccccgccgcaccttctaccgcctgctggacaagtaccgcctgcgcgagcgcgacgtgcgctaa

SEQ ID NO: 274 - DNA, 1353 bp, Clostridium acetobutylicum
atgaacaacaagtacatcgagctgttcaagagcctggtggacagctactacaacgacaccttcgacagcttcgtgtaccacatcctgagcgacgaggaggtggacaagaaggagctgagcaaggtgatcagcagcctgtgcggcgtgagcgtggagttcaaggacaccgagacctacatcagcgagctgaagaaggccatcagcaactacaagtgcaccgacaacatcgtggagaagatcaaggagtgcgacagcagctgccacagcaacgagggcgagaccccctgccagaagagctgccccttcgacgccatcctggtggacaagaacaccaagaccagccacatccagaaggacctgtgcaccgactgcggcaactgcatcaccagctgccccagcggcagcatcctggacaagatcgagttcatgcccctgctgaacctgttcaagaacaacgagaccgtgatcgccgccgtggcccccgccatcgccggccagttcggcgagaacgtgagcctggagatgctgcgcaccgccttcaagaaggtgggcttcgccgacatggtggaggtggccttcttcgccgacatgctgaccatcaaggaggccttcgagttcaacgagctggtgaacagcaaggacgacctgatgatcaccagctgctgctgccccatgtgggtgagcatgatccgcaagatctacaaggacctggcccgccacgtgagccccagcgtgagccccatgatcgccagcggccgcgtgatcaagaagctgaaccccaactgcaaggtggtgttcatcggcccctgcatcgccaagaaggccgagagccgcagccaggacatcagcgacgccatcgacttcgtgctgaccttcgaggagctgaagggcatcttcgacgtgctggacatcgaccccgagaagctgcccgagacccacaccaagagctacgccagccgcgagggccgcctgtacggccgcaccggcggcgtgagcaccagcgtggacgaggccgtgaagcgcatcttccccaacaagcaccacctgttcaagagcaccaaggtggacggcgtgaaggactgcaaggacatcctgaacaagacccaggccggcaacatcggcgccaacttcctggagggcatgggctgcgtgggcggctgcgtgggcggccccaaggccatcgtgcacaaggaccagggccgcgagagcgtgaacaagaccgccgagagcagcgagatcaagatcagcgtggacagcgagcgcatgaaggacatcctgagccgcatcggcatcaacagcatcgaggacttcggcgacaagagcaaggtggacatcttcgagcgccgcttctaa

SEQ ID NO: 275 - DNA, 321 bp, Shewanella oneidensis
atgaacaagaagaagcacctgttcgccgaggacagcttcttcctgagccgccgcaagttcatggccgtgggcgccgccttcgtggccgccctggccatccccatcggctggttcaccagcaagctggagcgccgcaacgagtacatcaaggcccgcagccagggcctgtacaaggacgacagcctggccaagacccgcgtgagccacgccaaccccgccgtggagaagtactacaaggagttcggcggcgagcccctgggccacatgagccacgagctgctgcacacccacttcgtggaccgcaccaagctgagcagctaa

SEQ ID NO: 276 - DNA, 1515 bp, Entamoeba histolytica
atgagcacccagctgacccccctgcgcaacaagatcatcagcgaggtggtgaagtgcttcaagagcggccgcttcatcgaggacatcgacaagctgcccaccatcctgaccgacggcgacggctggaagcccaccagcaagttcgtgcacagccgcgagcaggaggagggcatctaccgcgagaaggtgctgagcgtgctgggcttcgtggacggcgagtacgacgacatcacccccctgcacgtgtacgcccagaaggccctggagcgcaccagcctgcacgagcccgtgttcggcatcagccagaagggctgcaacaagtgccacttcaacggctacttcgtgacccaggcctgcgagggctgcaccagccgcccctgcagcgtgaactgccccaagaagtgcatcagcttcggcgaggacggccgcgccgtgatcaaccagaacaactgcatcaagtgcggccgctgctacaagttctgcccctacggcgccatcatcagcaagagcgtgccctgcgtgaaggcctgcccctgcggcgccatgctggacagccccgagggcgtgaagaccatcgacttcgagaagtgcatcaactgcggcggctgcatgcgcgcctgccccttcggcgccatcctgccccgcagcaacctgatcgacgtgctgaagatcctgcccaccaagaaggtggtggcctgccccgcccccagcatcgccgcccacttcggcaagtacgacctggccctggtgagcggcggcctgatccaggtgggcttcaccagcgtggaggacgtgagctacggcgccgacctgtgcgccctgaacgaggccaaggagttcgaggagcgcatcgtgaagaacaagaaggacttcatgaccaccagctgctgccccgcctacatcaacgccatcaacaagcacatgcccgagctgaaggagaacgtgagccacacccccacccccatgcacttcgccacccaggccgtgaaggaccgcgaccaggagaccgtgaccgtgttcatcggcccctgcaacgccaagcgctgggagaccctgcaggacagcaccaccgactactgcctgaccttcgacgagatcttcggcctgttcgagggcagcggcatcgacctgagcaaggtgcagccctacaccttcgtggacaaggcccacaaggagggcaagatcttcgccgtgagcggcggcgtggccagcgccgtggccagcctgctgcccaaggaggtgcccgacggcgtgatcaagcccaccatcatcgacggcttcagccaggagaacttcaagcgcctgaagaacttcaagaagaacatcaccggcaacctggtggaggtgatggtgtgcgagggcggctgcgcctacggccccggctgccccggcctgaacacccccgccaccagcgccaagatcaagatcgccgtggacaagatggaggcccaccccgagggccgctgggtgggcctgcccaacagccagatcaagcccatcaaggtggagaactaa

SEQ ID NO: 277 - DNA, 1683 bp, Cryptosporidium parvum
atgttcagcaccgccgtgaagctggccaacctggacgactacctggagagcagccaggactgcatcgtgagcctgctgagcgacaaggacgacaccaagcccaagatcgccgtgatgcgccccgccaaggcccagggcaacaaggacgacaagaagagcggcaccagcgacaaggccaccgtgaacgtggccgactgcctggcctgcagcggctgcgtgaccagcgccgaggccaagctgctggaggaccagaacgtgagcgagttcatgaacatcctgaagcagaagcgcctgaccgtggtgagcatcagcaaccagagctgcagcagcttcgcctgccacctgaactgcgacctgatcaccatccagcgcaagctgagcggcctgttcaagcacatcggcgcccgcttcgtgatgaacagcaccatcagcgagtacatcagcctgctggagaccaagtacgagttcatcagccgctacaaggccaagagcgacctgcccatgatcatcagccactgccccggctggatctgctacagcgagaagagcctgaacagcagcgtgctgcccctgctgagcaaggtgcgcagcgcccagcagctgcagggcatcctgatcaagaccctgaccctggagatctacaaccagctgctgttcctgtacaagttccgcctgagcaacagctaccgcaccaacatgaacgtgaagagcaccttcacccagaacgacaacttcgtggagcagagcgacatcttccacgtggccatcatgccctgccacgacaagaagctggagagcacccgcagcagcctgagcctgaagagcagcgacaagaacagcagctgccccgaggtggacatcgtgctggccaccagcgaggtgggcgagatcatcaagctggccggcttcaacagcctgctggacgtgcccgaggcccccctggacaacctgtggctgaaccagaacttccagatcaccaagaagcacaacctgagcctgctgatcaccgagaactacgtgagcaaccagatcctgaaccagttcagctggctgatccccagctacttcaacagcaacagcggcggcttctgcgagtacatcatccgcagcgccatcaaggagctggccggcgaccacatcgacaacaaggtgcagctgcccttcaacaagctgaagaacgacatcctggaggccaagtacatcaagaacaacgtggagctgaactactgcctggcctacggcttccgcgccatccagagcatcagccgcaagctgaacctgcagaagaacgccagccagaacacccagtacaagcagagcgtggtgaaccacgtgaactaccacctgatcgaggccatggcctgccccaccggctgcgtgagcggcggcggccagatcctgagccagaacgaccagaacgacgacaacagcgacctgaacaagctgcgcaagaacatcaagttcatcgacgaggtgcaggaggccctgtacaagggcatcaacctgaacaagaaccaggaggtgatcctgcccgacgagatccccatcgtgaacatcctgtacgagtacctgatccacatcgacaagcagatcgaccgcagcagcggcctgaagctgcccttcctgcgcaacgacttcgtgagcatcaacgaggtgcccaccgccagcagcctgaagtggtaa

SEQ ID NO: 278 - DNA, 1410 bp, Kluyveromyces lactis
atgagcgccctgctgcgcgacgccgacctgaacgacttcatcagccccggcctggcctgcgtgaagcccgcccagccccagaaggtggagaagaagcccagcttcgaggtggaggtgggcatcgagagcagcgagcccgagaaggtgagcatcagcctgcaggactgcctggcctgcgccggctgcatcaccagcagcgaggagatcctgctgagcaagcagagccacaaggtgttcctggagaagtggagcgagctggaggagctggacgagcgcagcctggccgtgagcatcagcccccagtgccgcctgagcctggccgactactacagcatgtgcctggccgacctggaccgctgcttccagaacttcatgaagaccaagttcaacgccaagtacgtggtgggcacccagttcggccgcagcatcagcatcagccgcatcaacgccaccctgaaggaccgcgtgcccgagaacgagggccccctgctgtgcagcgtgtgccccggcttcgtgctgtacgccgagaagaccaagcccgagctgatcccccacatgctggacgtgaagagcccccagcagatcaccggcaacctgctgaagcaggccgaccccacctgctaccacctgagcatcatgccctgcttcgacaagaagctggaggccagccgcgaggagtgcgagaaggaggtggactgcgtgatcacccccaagcagttcgtggccatgctgggcgacctgagcatcgacttcaagagctacatgaccgagtacgacagcagcaaggagctgtgccccagcggctgggactacaagctgcactggctgagcaacgagggcagcagcagcggcggctacgcctaccagtacctgctgagcctgcagagcagcaaccccgagagcgacatcatcaccatcgagggcaagaacagcgacgtgaccgagtaccgcctggtgagcaagagcaagggcgtgatcgccagcagcagcgaggtgtacggcttccgcaacatccagaacctggtgcgcaagctgagccagagcgccagcgtgaagaagcgcggcatcaaggtgaagcgccgcggccagagcgtgctgaagagcggcgagaccagcgagaagaccaccaaggtgctgaccgccgaccccgccaagaccgacttcgtggaggtgatggcctgccccagcggctgcatcaacggcggcggcctgctgaacgaggagaagaacgccaaccgccgcaagcagctggcccaggacctgagcctggcctacaccaaggtgcacagcgtgaacatccccgacatcgtgcacgcctacgacgacaagagcaacgacttcaagtacaacctgcgcgtgatcgagcccagcaccagcagcgacgtggtggccgtgggcaacacctggtaa

SEQ ID NO: 279 - DNA, 1098 bp, Encephalitozoon cuniculi
atggacgccctgatccgcccccccatgagcttcttcgccgacctgcccaaggacaacaagaagtgcatcaagatcggcagccccctggccctgagcctgagcgactgcctggcctgcagcggctgcgtgagcgccgacgaggccggcgccctgagcgaggacctgagcttcgtgctggacctgagcccccagaccagcttcgtgctgagcccccagagcaagatcaacatcttcaacctgtaccgcgaggacggcatggagtaccgcgagttcgaggccgtgctgagcagcttcctgcgcagcaagttcaacatccaccgcatcgtggacaccagctacctgcgcagcaagatctacgaggagacctaccgcgagtacatggccaccaaccacctgatcgtgagcgcctgccccggcgtggtgacctacatcgagcgcaccgccccctacctgatcggctacctgagccgcgtgaagagcccccagcagatggccttcagcctggtgaagggcagccgcaccgtgagcgtgatgccctgccaggacaagaagctggagaacggccgcgacggcgtgaagttcgacttcatcctgaccacccgcggcttctgcaaggccctggacagcctgggcttccgccgccccgcccgcgccagcggcaagagcctgtgcagcatggaggaggccgagaccacccagtggaacatcggcaccagcagcggcggctacgccgagttcatcctgggcaagcactgcgtggtggagacccgcgagatccgcaacggcatcaaggagcacctgctggacgacggccgcaccatcagccagatcaccggcctggagaacagcatcaactacttcaagagcagcaagaccaagggcccccgccacaagatgaccgagatcttcctgtgcaagaacggctgcatcggcggccccggccaggagcgcgtgaacgacgtggagatggacatccgcgagtacgaccgcaacggccgcgagcagccccgcatcttctacagcagccccggcctggaggagaagcgcgtgttccgcgaggtgaaggccaagcgcgtggacctgcgcgtggactggtaa

SEQ ID NO: 280 - DNA, 384 bp, Tritrichomonas foetus
  misc_feature (253)..(253): n is a, c, g, or t
  misc_feature (372)..(372): n is a, c, g, or t
atgtgcatcaaggcctgcaacagcgtggccggccagggcgtgctgaagctggtgaaggtgggcaacaagaagctggtgagcaccaagagcggcaagcccctgcaggagaccaactgcatcaagtgcggccagtgcaccctggtgtgcggccccggcgccctgacccagaaggacgccatccagaccgtgagcgaggtgctgaagaaccccggcgacaaggtgctggtgtgccagaccgcccccgccatccgcntcaacctggccgacggcctgggcatgcccgccggcagcatcatcaccggcaagatggtgaccgccctgaagatgctgggcttcaagtacgtgttcgacaccaacttcggcaccgacttnaccatcggctaa

SEQ ID NO: 281 - DNA, 1233 bp, Shewanella oneidensis
atgaccaccaccacctaccagcccggcgagatccagggcctgatcaagatcaacgccagcaagtgcaagggctgcgacgcctgcaagcagttctgccccacccacgccatcaacggcgccagcggcgccgtgcacagcatcgacgaggacaagtgcctgagctgcggccagtgcctgatcaactgccccttcagcgccatcgaggagacccacagcgccctggagaccgtgatcaagaagctggccgacaagaacaccaccgtggtgggcatcatcgcccccgccgtgcgcgtggccatcggcgaggagttcggcctgggcaccggcgagctggtgaccggcaagctgtacggcgccatgaaccaggccggcttcaagatcttcgactgcaacttcgccgccgacctgaccatcatggaggagggcagcgagttcatccaccgcctgcacgccaacgtgaagggcgaggccaacgccggccccctgccccagttcaccagctgctgccccggctgggtgcgctacctggagacccgctaccccgccctgctgcccaacctgagcaccgccaagagcccccagcagatggccggcaccgtggccaagacctacggcgccaaggtgtaccagatgcagcccgagaacatcttcaccgtgagcgtgatgccctgcaccagcaagaagctggaggccagccgccccgagttcaacagcgcctggcagtaccaccaggagcacggcgccaacagccccagctaccaggacatcgacgccgtgctgaccacccgcgagatggcccagctgctgaagctgctggacatcgacctggccaacaccgccgagtaccagggcgacagcctgttcagcgagtacaccggcgccggcaccatcttcggcaccaccggcggcgtgatggaggccgccctgcgcaccgcccacaaggtgctgaccggcaccgagatggccaagctggagttcgagcccgtgcgcggcctgaagggcgtgaagagcgccagcgtgagcctgttcgacaccgagctgaaccaggacgtgaccgtgaacgtggccgtggtgcacgacatgggcaacaacatcgagcccgtgctgcgcgacgtgatggccggcaccagcccctaccacttcatcgaggtgatgaactgcgccggcggctgcgtgaacggcggcggccagcccatcgagggcaagggcagcagctggctgggcaacatctaa

SEQ ID NO: 282 - protein, 13 aa, Artificial
  Synthetic Construct
FGNSGGVMEAALR

SEQ ID NO: 283 - DNA, 39 bp, Artificial
  Synthetic Construct
ttcggcaacagcggcggcgtgatggaggccgccctgcgc

SEQ ID NO: 284 - protein, 13 aa, Artificial
  Synthetic Construct
FCATGGVMEAALR

SEQ ID NO: 285 - DNA, 39 bp, Artificial
  Synthetic Construct
ttctgcgccaccggcggcgtgatggaggccgccctgcgc

SEQ ID NO: 286 - protein, 13 aa, Artificial
  Synthetic Construct
FAATGGVMEAALR

SEQ ID NO: 287 - DNA, 39 bp, Artificial
  Synthetic Construct
ttcgccgccaccggcggcgtgatggaggccgccctgcgc

SEQ ID NO: 288 - protein, 13 aa, Artificial
  Synthetic Construct
FGTTGGVMEAAIR

SEQ ID NO: 289 - DNA, 38 bp, Artificial
  Synthetic Construct
tcggcaccaccggcggcgtgatggaggccgccatccgc

SEQ ID NO: 290 - protein, 13 aa, Artificial
  Synthetic Construct
FGVSGGVMEAAIR

SEQ ID NO: 291 - DNA, 39 bp, Artificial
  Synthetic Construct
ttcggcgtgagcggcggcgtgatggaggccgccatccgc

SEQ ID NO: 292 - protein, 13 aa, Artificial
  Synthetic Construct
FGLTGGVMEAAIR

SEQ ID NO: 293 - DNA, 39 bp, Artificial
  Synthetic Construct
ttcggcctgaccggcggcgtgatggaggccgccatccgc

SEQ ID NO: 294 - protein, 13 aa, Artificial
  Synthetic Construct
FCTSGGVMEAAIR

SEQ ID NO: 295 - DNA, 39 bp, Artificial
  Synthetic Construct
ttctgcaccagcggcggcgtgatggaggccgccatccgc

SEQ ID NO: 296 - protein, 13 aa, Artificial
  Synthetic Construct
FCATGGVMEAAIR

SEQ ID NO: 297 - DNA, 39 bp, Artificial
  Synthetic Construct
ttctgcgccaccggcggcgtgatggaggccgccatccgc

SEQ ID NO: 298 - protein, 13 aa, Artificial
  Synthetic Construct
FAATGGVMEAAIR

SEQ ID NO: 299 - DNA, 39 bp, Artificial
  Synthetic Construct
ttcgccgccaccggcggcgtgatggaggccgccatccgc

SEQ ID NO: 300 - protein, 13 aa, Artificial
  Synthetic Construct
FGATGGVMEAAVR

SEQ ID NO: 301 - DNA, 39 bp, Artificial
  Synthetic Construct
ttcggcgccaccggcggcgtgatggaggccgccgtgcgc

SEQ ID NO: 302 - protein, 13 aa, Artificial
  Synthetic Construct
FGNSGGVMEAAVR

SEQ ID NO: 303 - DNA, 39 bp, Artificial
  Synthetic Construct
ttcggcaacagcggcggcgtgatggaggccgccgtgcgc

SEQ ID NO: 304 - protein, 13 aa, Artificial
  Synthetic Construct
FGTTGGVMEAAVR

SEQ ID NO: 305 - DNA, 39 bp, Artificial
  Synthetic Construct
ttcggcaccaccggcggcgtgatggaggccgccgtgcgc

SEQ ID NO: 306 - protein, 13 aa, Artificial
  Synthetic Construct
FGVSGGVMEAAVR

SEQ ID NO: 307 - DNA, 39 bp, Artificial
  Synthetic Construct
ttcggcgtgagcggcggcgtgatggaggccgccgtgcgc

SEQ ID NO: 308 - protein, 13 aa, Artificial
  Synthetic Construct
FGLTGGVMEAAVR

SEQ ID NO: 309 - DNA, 39 bp, Artificial
  Synthetic Construct
ttcggcctgaccggcggcgtgatggaggccgccgtgcgc

SEQ ID NO: 310 - protein, 13 aa, Artificial
  Synthetic Construct
FCTSGGVMEAAVR

SEQ ID NO: 311 - DNA, 38 bp, Artificial
  Synthetic Construct
tctgcaccagcggcggcgtgatggaggccgccgtgcgc

SEQ ID NO: 312 - protein, 13 aa, Artificial
  Synthetic Construct
FAATGGVMEAAVR

SEQ ID NO: 313 - DNA, 39 bp, Artificial
  Synthetic Construct
ttcgccgccaccggcggcgtgatggaggccgccgtgcgc

SEQ ID NO: 314 - protein, 13 aa, Artificial
  Synthetic Construct
FCATGGVMEAASR

SEQ ID NO: 315 - DNA, 39 bp, Artificial
  Synthetic Construct
ttctgcgccaccggcggcgtgatggaggccgccagccgc

SEQ ID NO: 316 - protein, 13 aa, Artificial
  Synthetic Construct
FGVTGGVMEAASR

SEQ ID NO: 317 - DNA, 39 bp, Artificial
  Synthetic Construct
ttcggcgtgaccggcggcgtgatggaggccgccagccgc

SEQ ID NO: 318 - protein, 13 aa, Artificial
  Synthetic Construct
FGATGGVMEAASR

SEQ ID NO: 319 - DNA, 39 bp, Artificial
  Synthetic Construct
ttcggcgccaccggcggcgtgatggaggccgccagccgc

SEQ ID NO: 320 - protein, 13 aa, Artificial
  Synthetic Construct
FGNSGGVMEAASR

SEQ ID NO: 321 - DNA, 39 bp, Artificial
  Synthetic Construct
ttcggcaacagcggcggcgtgatggaggccgccagccgc

SEQ ID NO: 322 - protein, 13 aa, Artificial
  Synthetic Construct
FGTTGGVMEAASR

SEQ ID NO: 323 - DNA, 39 bp, Artificial
  Synthetic Construct
ttcggcaccaccggcggcgtgatggaggccgccagccgc

SEQ ID NO: 324 - protein, 13 aa, Artificial
  Synthetic Construct
FGVSGGVMEAASR

SEQ ID NO: 325 - DNA, 39 bp, Artificial
  Synthetic Construct
ttcggcgtgagcggcggcgtgatggaggccgccagccgc

SEQ ID NO: 326 - protein, 13 aa, Artificial
  Synthetic Construct
FGLTGGVMEAASR

SEQ ID NO: 327 - DNA, 39 bp, Artificial
  Synthetic Construct
ttcggcctgaccggcggcgtgatggaggccgccagccgc

SEQ ID NO: 328 - protein, 13 aa, Artificial
  Synthetic Construct
FCTSGGVMEAASR

SEQ ID NO: 329 - DNA, 39 bp, Artificial
  Synthetic Construct
ttctgcaccagcggcggcgtgatggaggccgccagccgc

SEQ ID NO: 330 - DNA, 786 bp, Pyrococcus furiosus
atgggcaaagtgcgcattggcttttatgcgctgaccagctgctatggctgccagctgcagctggcgatgatggatgaactgctgcagctgattccgaacgcggaaattgtgtgctggtttatgattgatcgcgatagcattgaagatgaaaaagtggatattgcgtttattgaaggcagcgtgagcaccgaagaagaagtggaactggtgaaaaaaattcgcgaaaacgcgaaaattgtggtggcggtgggcgcgtgcgcggtgcagggcggcgtgcagagctggagcgaaaaaccgctggaagaactgtggaaaaaagtgtatggcgatgcgaaagtgaaatttcagccgaaaaaagcggaaccggtgagcaaatatattaaagtggattataacatttatggctgcccgccggaaaaaaaagattttctgtatgcgctgggcacctttctgattggcagctggccggaagatattgattatccggtgtgcctggaatgccgcctgaacggccatccgtgcattctgctggaaaaaggcgaaccgtgcctgggcccggtgacccgcgcgggctgcaacgcgcgctgcccgggctttggcgtggcgtgcattggctgccgcggcgcgattggctatgatgtggcgtggtttgatagcctggcgaaagtgtttaaagaaaaaggcatgaccaaagaagaaattattgaacgcatgaaaatgtttaacggccatgatgaacgcgtggaaaaaatggtggaaaaaatttttagcggcggcgaacagtaa

SEQ ID NO: 331 - DNA, 759 bp, Escherichia coli
atgagcccggtgctgacccagcatgtgagccagccgattaccctggatgaacagacccagaaaatgaaacgccatctgctgcaggatattcgccgcagcgcgtatgtgtatcgcgtggattgcggcggctgcaacgcgtgcgaaattgaaatttttgcggcgattaccccggtgtttgatgcggaacgctttggcattaaagtggtgagcagcccgcgccatgcggatattctgctgtttaccggcgcggtgacccgcgcgatgcgcatgccggcgctgcgcgcgtatgaaagcgcgccggatcataaaatttgcgtgagctatggcgcgtgcggcgtgggcggcggcatttttcatgatctgtatagcgtgtggggcggcagcgataccattgtgccgattgatgtgtggattccgggctgcccgccgaccccggcggcgaccattcatggctttgcggtggcgctgggcctgctgcagcagaaaattcatgcggtggattatcgcgatccgaccggcgtgaccatgcagccgctgtggccgcagattccgccgagccagcgcattgcgattgaacgcgaagcgcgccgcctggcgggctatcgccagggccgcgaaatttgcgatcgcctgctgcgccatctgagcgatgatccgaccggcaaccgcgtgaacacctggctgcgcgatgcggatgatccgcgcctgaacagcattgtgcagcagctgtttcgcgtgctgcgcggcctgcatgattaa

SEQ ID NO: 332 - DNA, 711 bp, Methanothermobaccer thermautotrophicus
atggcggaagaaaacgcgaaaccgcgcattggctatattcatctgagcggctgcaccggcgatgcgatgagcctgaccgaaaactatgatattctggcggaactgctgaccaacatggtggatattgtgtatggccagaccctggtggatctgtgggaaatgccggaaatggatctggcgctggtggaaggcagcgtgtgcctgcaggatgaacatagcctgcatgaactgaaagaactgcgcgaaaaagcgaaactggtgtgcgcgtttggcagctgcgcgcagaccggctgctttacccgctatagccgcggcggccagcaggcgcagccgagccatgaaagctttgtgccgattgcggatctgattgatgtggatctggcgattccgggctgcccgccgagcccggaaattattgcgaaagcggtggtggcgctgctgaacaacgatatggaatatctgcagccgatgctggatctggcgggctataccgaagcgtgcggctgcgatctgcagaccaaagtggtgaaccagggcctgtgcaccggctgcggcacctgcgcgatggcgtgccagacccgcgcgctggatatgaccaacggccgcccggaactgaacagcgatcgctgcattaaatgcggcatttgctatgtgcagtgcccgcgcagctggtggccggaagaacagattaaaaaagaactgggcctgtaa

SEQ ID NO: 333 - DNA, 780 bp, Methanosarcina barkeri
atggcgaacaaaattaaactgggccatgtgcatctgagcggctgcaccggctgcctggtgagcgtggcggataactatcagggctttctgaaaattctggatgattatgcggatctggtgtattgcctgaccctggcggatgtgcgccatattccggaaatggatgtggcgctggtggaaggcagcgtgtgcattcaggatcgcgaaagcgtggaagatattaaagaaacccgcaaaaaaagccgcattgtggtggcgctgggcagctgcgcgagctatggcaacattacccgcttttgccgcggcggccagcataaccatccgcagcatgaaagctatctgccgattggcgatctgattgatgtggatgtgtatattccgggctgcccgccgagcccggaactgattcgcaacgtggcgattatggcgtatctgctgctggaaggcaacgaagaacagaaagatctggcgggccgctatctgaaaccgctgatggatctggcgaaacgcggcaccaccggctgcttttgcgatctgatggatgatgtgattaaccagggcctgtgcattggctgcggcatttgcgcggcgagctgcccggtgcgcgcgattacccatgaatttggcaaaccgcagggcgatctgaacctgtgcattaaatgcggcagctgctatggcgcgtgcccgcgcagcttttttaacccggatgtgattagcgaatttgaaagcattaacgaaattattgcgggcgcgctgaaagaaggcgaaaaagatgattaa

SEQ ID NO: 334 - DNA, 429 bp, Rhodospirillum rubrum
atgaactttctgagccgcatgagcaaaaaaagcccgtggctgtatcgcattaacgcgggcagctgcaacggctgcgatgtggaactggcgaccaccgcgtgcattccgcgctatgatgtggaacgcctgggctgccagtattgcggcagcccgaaacatgcggatattgtgctggtgaccggcccgctgaccgcgcgcgtgaaagataaagtgctgcgcgtgtatgaagaaattccggatccgaaagtgaccgtggcgattggcgtgtgcccgattagcggcggcgtgtttcgcgaaagctatagcattgtgggcccgattgatcgctatctgccggtggatgtgaacgtgccgggctgcccgccgcgcccgcaggcgattattgaaggcattgcgaaagcgattgaaatttgggcgggccgcatttaa

SEQ ID NO: 335 - DNA, 1287 bp, Pyrococcus furiosus
atgaaaaacctgtatctgccgattaccattgatcatattgcgcgcgtggaaggcaaaggcggcgtggaaattattattggcgatgatggcgtgaaagaagtgaaactgaacattattgaaggcccgcgcttttttgaagcgattaccattggcaaaaaactggaagaagcgctggcgatttatccgcgcatttgcagcttttgcagcgcggcgcataaactgaccgcgctggaagcggcggaaaaagcggtgggctttgtgccgcgcgaagaaattcaggcgctgcgcgaagtgctgtatattggcgatatgattgaaagccatgcgctgcatctgtatctgctggtgctgccggattatcgcggctatagcagcccgctgaaaatggtgaacgaatataaacgcgaaattgaaattgcgctgaaactgaaaaacctgggcacctggatgatggatattctgggcagccgcgcgattcatcaggaaaacgcggtgctgggcggctttggcaaactgccggaaaaaagcgtgctggaaaaaatgaaagcggaactgcgcgaagcgctgccgctggcggaatatacctttgaactgtttgcgaaactggaacagtatagcgaagtggaaggcccgattacccatctggcggtgaaaccgcgcggcgatgcgtatggcatttatggcgattatattaaagcgagcgatggcgaagaatttccgagcgaaaaatatcgcgattatattaaagaatttgtggtggaacatagctttgcgaaacatagccattataaaggccgcccgtttatggtgggcgcgattagccgcgtgattaacaacgcggatctgctgtatggcaaagcgaaagaactgtatgaagcgaacaaagatctgctgaaaggcaccaacccgtttgcgaacaacctggcgcaggcgctggaaattgtgtattttattgaacgcgcgattgatctgctggatgaagcgctggcgaaatggccgattaaaccgcgcgatgaagtggaaattaaagatggctttggcgtgagcaccaccgaagcgccgcgcggcattctggtgtatgcgctgaaagtggaaaacggccgcgtgagctatgcggatattattaccccgaccgcgtttaacctggcgatgatggaagaacatgtgcgcatgatggcggaaaaacattataacgatgatccggaacgcctgaaaattctggcggaaatggtggtgcgcgcgtatgatccgtgcattagctgcagcgtgcatgtggtgcgcctgtaa

SEQ ID NO: 336 - DNA, 1668 bp, Escherichia coli
atgaacgtgaacagcagcagcaaccgcggcgaagcgattctggcggcgctgaaaacccagtttccgggcgcggtgctggatgaagaacgccagaccccggaacaggtgaccattaccgtgaaaattaacctgctgccggatgtggtgcagtatctgtattatcagcatgatggctggctgccggtgctgtttggcaacgatgaacgcaccctgaacggccattatgcggtgtattatgcgctgagcatggaaggcgcggaaaaatgctggattgtggtgaaagcgctggtggatgcggatagccgcgaatttccgagcgtgaccccgcgcgtgccggcggcggtgtggggcgaacgcgaaattcgcgatatgtatggcctgattccggtgggcctgccggatcagcgccgcctggtgctgccggatgattggccggaagatatgcatccgctgcgcaaagatgcgatggattatcgcctgcgcccggaaccgaccaccgatagcgaaacctatccgtttattaacgaaggcaacagcgatgcgcgcgtgattccggtgggcccgctgcatattaccagcgatgaaccgggccattttcgcctgtttgtggatggcgaacagattgtggatgcggattatcgcctgttttatgtgcatcgcggcatggaaaaactggcggaaacccgcatgggctataacgaagtgacctttctgagcgatcgcgtgtgcggcatttgcggctttgcgcatagcgtggcgtataccaacagcgtggaaaacgcgctgggcattgaagtgccgcagcgcgcgcataccattcgcagcattctgctggaagtggaacgcctgcatagccatctgctgaacctgggcctgagctgccattttgtgggctttgataccggctttatgcagttttttcgcgtgcgcgaaaaaagcatgaccatggcggaactgctgattggcagccgcaaaacctatggcctgaacctgattggcggcgtgcgccgcgatattctgaaagaacagcgcctgcagaccctgaaactggtgcgcgaaatgcgcgcggatgtgagcgaactggtggaaatgctgctggcgaccccgaacatggaacagcgcacccagggcattggcattctggatcgccagattgcgcgcgatctgcgctttgatcatccgtatgcggattatggcaacattccgaaaaccctgtttacctttaccggcggcgatgtgtttagccgcgtgatggtgcgcgtgaaagaaacctttgatagcctggcgatgctggaatttgcgctggataacatgccggataccccgctgctgaccgaaggctttagctataaaccgcatgcgtttgcgctgggctttgtggaagcgccgcgcggcgaagatgtgcattggagcatgctgggcgataaccagaaactgtttcgctggcgctgccgcgcggcgacctatgcgaactggccggtgctgcgctatatgctgcgcggcaacaccgtgagcgatgcgccgctgattattggcagcctggatccgtgctatagctgcaccgatcgcgtgaccctggtggatgtgcgcaaacgccagagcaaaaccgtgccgtataaagaaattgaacgctatggcattgatcgcaaccgcagcccgctgaaataa

SEQ ID NO: 337 - DNA, 1218 bp, Methanothermobaccer thermautotrophicus
atgagcgaacgcattgtgattagcccgaccagccgccaggaaggccatgcggaactggtgatggaagtggatgatgaaggcattgtgaccaaaggccgctattttagcattaccccggtgcgcggcctggaaaaaattgtgaccggcaaagcgccggaaaccgcgccggtgattgtgcagcgcatttgcggcgtgtgcccgattccgcataccctggcgagcgtggaagcgattgatgatagcctggatattgaagtgccgaaagcgggccgcctgctgcgcgaactgaccctggcggcgcatcatgtgaacagccatgcgattcatcattttctgattgcgccggattttgtgccggaaaacctgatggcggatgcgattaacagcgtgagcgaaattcgcaaaaacgcgcagtatgtggtggatatggtggcgggcgaaggcattcatccgagcgatgtgcgcattggcggcatggcggataacattaccgaactggcgcgcaaacgcctgtatgcgcgcctgaaacagctgaaaccgaaagtggatgaacatgtggaactgatgattggcctgattgaagataaaggcctgccgaaaggcctgggcgtgcataaccagccgaccctggcgagccatcagatttatggcgatcgcaccaaatttgatctggatcgctttaccgaagtgatgccggaaagctggtatgatgatccggaaattgcgaaacgcgcgtgcagcaccattccgctgtatgatggccgcaacgtggaagtgggcccgcgcgcgcgcatggtggaatttcagggctttaaagaacgcggcgtggtggcgcagcatgtggcgcgcgcgctggaaatgaaaaccgcgctggcgcgcgcgattgaaattctggatgaactggataccagcgcgccggtgcgcgcggattttgatgaacgcggcaccggcaaactgggcgtgggcgcgattgaaggcccgcgcggcctggatgtgcatatggcgcaggtggaaaacggcaaaattcagttttatagcgcgctggtgccgaccacctggaacattccgaccatgggcccggcgaccgaaggctttcatcatgaatatggcccgcatgtgattcgcgcgtatgatccgtgcctgagctgcgcgacccatgtgatggtggtggatgatgaagatcgcagcgtgattcgcgatgaaatggtgcgcctgtaa

SEQ ID NO: 338 - DNA, 1371 bp, Methanosarcina barkeri
atgaccaaagtggtggaaattagcccgaccacccgccatgaaggccatagcaaactgaccctgaaagtgaacgatgaaggcattgtggaacgcggcgattggctgagcaccaccccggtgcgcggcattgaaaaactggcgattggcaaaaccatggatcaggtgccgaaaattgcgagccgcgtgtgcggcatttgcccgattgcgcataccctggcgggcattgaagcgatggaagcgagcattggctgcgaaattccgaaagatgcgaaactgctgcgcgtgattctgcatgcggcgaaccgcctgcatagccatgcgctgcataacattctgattctgccggatttttatattccggataccgaaaccaaaattaacccgtttagcaaagaacagccgctgcgcagcgtggcggtgcgcatttttcgcattcgcgaaattgcgcagaccattggcgcggtggcgggcggcgaagcgattcatccgagcaacccgcgcgtgggcggcatgtatcgcaacgtgagcagccgcgcgaaacagaaaattgcggatctggcgaaagaaggcctggtgctggcgcatgaacagatggaatttatgattgaagtgattcgcaacatgcaggatcgcgaatttgtggaagtggcgggcaaacagattccgctgccgaaaaccctgggctatcataaccagggcgtgatggcgaccgcgccgatgtatggcagcagcagcctggatgaaaaaccgatgtgggattttacccgctggcgcgaaacccgcccgtgggattggtatatgagcgaagaaaccattgatctggaagatagcagctatccgattggcggcaccaccaaagtgggcaccaaagtgaacccgcgcatggaagcgtgcaacaccgtgccgacctatgatggccagccggtggaagtgggcccgcgcgcgcgcctggcgacctttaaacattttaccgaaaaaggcacctttgcgcagcatattgcgcgccagatggaatataccgattgctattataccattctgaactgcctggaaaacctggataccagcggcaaagtgctggcggataccattccgctgggcaacggcagcatgggctgggcggcgaacgaagcgccgcgcggcaccgatgtgcatctggcgcgcgtgaaagatggcaaagtgctgcgctatgaaatgctggtgccgaccacctggaactttccgacctgcagccgcgcgctgaccggcgcgccgtggcagattgcggaaatggtgattcgcgcgtatgatccgtgcgtgagctgcgcgacccatatgattgtggtgaacgaagaagatcgcattgtggcgcagaaactgatgcagtggtaa

SEQ ID NO: 339 - DNA, 1086 bp, Rhodospirillum rubrum
atgagcacctataccattccggtgggcccgctgcatgtggcgctggaagaaccgatgtattttcgcattgaagtggatggcgaaaaagtggtgagcgtggatattaccgcgggccatgtgcatcgcggcattgaatatctggcgaccaaacgcaacatttatcagaacattgtgctgaccgaacgcgtgtgcagcctgtgcagcaacagccatccgcagacctattgcatggcgctggaaagcattaccggcatggtggtgccgccgcgcgcgcagtatctgcgcgtgattgcggatgaaaccaaacgcgtggcgagccatatgtttaacgtggcgattctggcgcatattgtgggctttgatagcctgtttatgcatgtgatggaagcgcgcgaaattatgcaggataccaaagaagcggtgtttggcaaccgcatggatattgcggcgatggcgattggcggcgtgaaatatgatctggataaagatggccgcgattattttattggccagctggataaactggaaccgaccctgcgcgatgaaattattccgctgtatcagaccaacccgagcattgtggatcgcacccgcggcattggcgtgctgagcgcggcggattgcgtggattatggcctgatgggcccggtggcgcgcggcagcggccatgcgtatgatgtgcgcaaacaggcgccgtatgcggtgtatgatcgcctggattttgaaatggcgctgggcgaacatggcgatgtgtggagccgcgcgatggtgcgctggcaggaagcgctgaccagcattggcctgattcgccagtgcctgcgcgatatgccggatggcccgaccaaagcgggcccggtgccgccgattccggcgggcgaagcggtggcgaaaaccgaagcgccgcgcggcgaactgatttattatctgaaaaccaacggcaccgatcgcccggaacgcctgaaatggcgcgtgccgacctatatgaactgggatgcgctgaacgtgatgatggcgggcgcgcgcattagcgatattccgctgattgtgaacagcattgatccgtgcattagctgcaccgaacgctaa

SEQ ID NO: 340 - DNA, 213 bp, Artificial
  Synthetic Construct
atgagcgccctggtgctgaagccctgcgccgccgtgagcatccgcggcagcagctgccgcgcccgccaggtggccccccgcgcccccctggccgccagcaccgtgcgcgtggccctggccaccctggaggcccccgcccgccgcctgggcaacgtggcctgcgccgccatgctggccagcagcagccgcgccgccgccaacatccgctgggtg

SEQ ID NO: 341 - DNA, 213 bp, Artificial
  Synthetic Construct
atgagcgccctggtgctgaagccctgcgccgccgtgagcatccgcggcagcagctgccgcgcccgccaggtggccccccgcgcccccctggccgccagcaccgtgcgcgtggccctggccaccctggaggcccccgcccgccgcctgggcaacgtggcctgcgccgccatgagcatgctgagcagcgtgctgaacaaggccgtggtgaacccc

SEQ ID NO: 342 - DNA, 213 bp, Artificial
  Synthetic Construct
atgagcgccctggtgctgaagccctgcgccgccgtgagcatccgcggcagcagctgccgcgcccgccaggtggccccccgcgcccccctggccgccagcaccgtgcgcgtggccctggccaccctggaggcccccgcccgccgcctgggcaacgtggcctgcgccgccatgccccccaagccccagcacgacgtgaccggcgtggacagcaac

SEQ ID NO: 343 - DNA, 381 bp, Chlamydomonas reinhardtii
atggccatggctatgcgctccaccttcgccgcccgcgttggcgctaagcccgctgtccgcggtgctcgccccgccagccgcatgagctgcatggcctacaaggtcaccctgaagaccccttcgggcgacaagaccattgagtgccccgctgacacctacatcctggacgctgctgaggaggccggcctggacctgccctactcttgccgcgctggtgcttgctccagctgcgccggcaaggtcgctgccggcaccgtcgaccagtcggaccagtccttcctggacgatgcccagatgggcaacggcttcgtgctgacctgcgtggcctaccccacctcggactgcaccatccagacccaccaggaggaggccctgtactaa

SEQ ID NO: 344 - protein, 17 aa, Artificial sequence
  peptide
  misc_feature (1)..(4): Xaa can be any naturally occurring amino acid
  misc_feature (6)..(6): Xaa can be any naturally occurring amino acid
  misc_feature (13)..(13): Xaa can be any naturally occurring amino acid
  misc_feature (15)..(17): Xaa can be any naturally occurring amino acid
XXXXPXFTSCCPXWXXX

SEQ ID NO: 345 - protein, 10 aa, Artificial sequence
  peptide
  misc_feature (2)..(2): Xaa can be any naturally occurring amino acid
  misc_feature (9)..(9): Xaa can be any naturally occurring amino acid
PXFTSCCPXW

SEQ ID NO: 346 - protein, 8 aa, Artificial sequence
  peptide
  misc_feature (2)..(2): Xaa can be any naturally occurring amino acid
PXFTSCCP

SEQ ID NO: 347 - protein, 13 aa, Artificial sequence
  peptide
  misc_feature (2)..(4): Xaa can be any naturally occurring amino acid
  misc_feature (12)..(12): Xaa can be any naturally occurring amino acid
FXXXGGVMEAAXR

SEQ ID NO: 348 - protein, 7 aa, Chlamydomonas reinhardtii
GGVMEAA

SEQ ID NO: 349 - protein, 9 aa, Artificial sequence
  peptide
  misc_feature (8)..(8): Xaa can be any naturally occurring amino acid
GGVMEAAXR

SEQ ID NO: 350 - protein, 18 aa, Artificial sequence
  peptide
  misc_feature (2)..(2): Xaa can be any naturally occurring amino acid
  misc_feature (4)..(4): Xaa can be any naturally occurring amino acid
  misc_feature (6)..(6): Xaa can be any naturally occurring amino acid
  misc_feature (8)..(9): Xaa can be any naturally occurring amino acid
  misc_feature (12)..(13): Xaa can be any naturally occurring amino acid
FXEXMXCXXGCXXGGGQP

SEQ ID NO: 351 - protein, 9 aa, Artificial sequence
  peptide
  misc_feature (3)..(4): Xaa can be any naturally occurring amino acid
GCXXGGGQP

SEQ ID NO: 352 - protein, 13 aa, Clostriduim pasteuranum
FGATGGVMEAALR

SEQ ID NO: 353 - protein, 13 aa, Desulfovibrio vulgaris
FGVTGGVMEAALR

SEQ ID NO: 354 - protein, 13 aa, Chlorella fusca
FGTTGGVMEAALR

SEQ ID NO: 355 - protein, 13 aa, Desulfovibrio desulfuricans
FGVSGGVMEAALR

SEQ ID NO: 356 - protein, 13 aa, Desulfovibrio desulfuricans
FGLTGGVMEAALR

SEQ ID NO: 357 - protein, 13 aa, Desulfovibrio desulfuricans
FCTSGGVMEAALR

SEQ ID NO: 358 - protein, 13 aa, Trichomonas vaginalis
FGATGGVMEAAIR

SEQ ID NO: 359 - protein, 13 aa, Neocallimastix frontalis
FGVTGGVMEAAIR

SEQ ID NO: 360 - protein, 13 aa, Megasphaera elsdenii
FGNSGGVMEAAIR

SEQ ID NO: 361 - protein, 13 aa, Trichomonas vaginalis
FCATGGVMEAAVR

SEQ ID NO: 362 - protein, 13 aa, Piromyces sp. E2
FGVTGGVMEAAVR

SEQ ID NO: 363 - protein, 13 aa, Trichomonas vaginalis
FAATGGVMEAASR

SEQ ID NO: 364 - protein, 13 aa, Artificial Sequence
  Synthetic Construct
  SITE (3)..(3): Xaa = A(Ala), V(Val), N(Asn), T(Thr), L(Leu)
  SITE (4)..(4): Xaa = T(Thr), S(Ser)
  site (12)..(12): Xaa = L(Leu), I(Ile), V(Val), S(Ser)
FAXXGGVMEAAXR

SEQ ID NO: 365 - protein, 13 aa, Artificial Sequence
  Synthetic construct
  SITE (3)..(3): Xaa = A(Ala), V(Val), N(Asn), T(Thr), L(Leu)
  SITE (4)..(4): Xaa = T(Thr),S(Ser)
  SITE (12)..(12): Xaa = L(Leu), I(Ile), V(Val), S(Ser)
FCXXGGVMEAAXR

SEQ ID NO: 366 - protein, 13 aa, Artificial Sequence
  Synthetic construct
  SITE (3)..(3): Xaa = A(Ala), V(Val), N(Asn), T(Thr), L(Leu)
  SITE (4)..(4): Xaa = T(Thr),S(Ser)
  SITE (12)..(12): Xaa = L(Leu), I(Ile), V(Val), S(Ser)
FGXXGGVMEAAXR

SEQ ID NO: 367 - protein, 13 aa, Artificial sequence
  Synthetic construct
  SITE (2)..(2): Xaa = G(Gly), C(Cys),  A(Ala)
  SITE (4)..(4): Xaa = T(Thr), S(Ser)
  SITE (12)..(12): Xaa = L(Leu), I(Ile), V(Val), S(Ser)
FXAXGGVMEAAXR

SEQ ID NO: 368 - protein, 13 aa, Artificial Sequence
  Synthetic construct
  SITE (2)..(2): Xaa = G(Gly), C(Cys), A(Ala)
  SITE (4)..(4): Xaa = T(Thr), S(Ser)
  SITE (12)..(12): Xaa = L(Leu), I(Ile), V(Val), S(Ser)
FXVXGGVMEAAXR

SEQ ID NO: 369 - protein, 13 aa, Artificial sequence
  Synthetic construct
  SITE (2)..(2): Xaa = G(Gly), C(Cys), A(Ala)
  SITE (4)..(4): Xaa = = T(Thr), S(Ser)
  SITE (12)..(12): Xaa = L(Leu), I(Ile), V(Val), S(Ser)
FXNXGGVMEAAXR

SEQ ID NO: 370 - protein, 13 aa, Artificial sequence
  Synthetic construct
  SITE (2)..(2): Xaa = G(Gly), C(Cys), A(Ala)
  SITE (4)..(4): Xaa = T(Thr), S(Ser)
  SITE (12)..(12): Xaa = L(Leu), I(Ile), V(Val), S(Ser)
FXTXGGVMEAAXR

SEQ ID NO: 371 - protein, 13 aa, Artificial sequence
  Synthetic construct
  SITE (2)..(2): Xaa = G(Gly), C(Cys), A(Ala)
  SITE (4)..(4): Xaa = T(Thr), S(Ser)
  SITE (12)..(12): Xaa = L(Leu), I(Ile), V(Val), S(Ser)
FXLXGGVMEAAXR

SEQ ID NO: 372 - protein, 13 aa, Artificial  sequence
  Synthetic construct
  SITE (2)..(2): Xaa = G(Gly), C(Cys), A(Ala)
  SITE (3)..(3): Xaa = A(Ala), V(Val), N(Asn), T(Thr), L(Leu)
  SITE (12)..(12): Xaa = L(Leu), I(Ile), V(Val), S(Ser)
FXXTGGVMEAAXR

SEQ ID NO: 373 - protein, 13 aa, Artificial sequence
  Synthetic construct
  SITE (2)..(2): Xaa = G(Gly), C(Cys), A(Ala)
  SITE (3)..(3): Xaa = L(Leu), I(Ile), V(Val), S(Ser)
  SITE (12)..(12): Xaa = L(Leu), I(Ile), V(Val), S(Ser)
FXXSGGVMEAAXR

SEQ ID NO: 374 - protein, 13 aa, Artificial sequence
  Synthetic construct
  SITE (2)..(2): Xaa = G(Gly), C(Cys), A(Ala)
  SITE (3)..(3): Xaa = A(Ala), V(Val), N(Asn), T(Thr), L(Leu)
  SITE (4)..(4): Xaa = T(Thr), S(Ser)
FXXXGGVMEAALR

SEQ ID NO: 375 - protein, 13 aa, Artificial sequence
  Synthetic construct
  SITE (2)..(2): Xaa = G(Gly), C(Cys), A(Ala)
  SITE (3)..(3): Xaa = A(Ala), V(Val), N(Asn), T(Thr), L(Leu)
  SITE (4)..(4): Xaa = T(Thr), S(Ser)
FXXXGGVMEAAIR

SEQ ID NO: 376 - protein, 13 aa, Artificial sequence
  Synthetic construct
  SITE (2)..(2): Xaa = G(Gly), C(Cys), A(Ala)
  SITE (3)..(3): Xaa = A(Ala), V(Val), N(Asn), T(Thr), L(Leu)
  SITE (4)..(4): Xaa = T(Thr), S(Ser)
FXXXGGVMEAAVR

SEQ ID NO: 377 - protein, 13 aa, Artificial sequence
  Synthetic construct
  SITE (2)..(2): Xaa = G(Gly), C(Cys), A(Ala)
  SITE (3)..(3): Xaa = A(Ala), V(Val), N(Asn), T(Thr), L(Leu)
  SITE (4)..(4): Xaa = T(Thr), S(Ser)
FXXXGGVMEAASR

What is claimed is:

1. A method of evolving an iron hydrogenase comprising:
   a. substituting at least one amino acid in an iron hydrogenase within the segment $FX^1X^2X^3G^1G^2VMEA^1A^2X^4R$ (SEQ ID NO: 347);
   b. transforming an organism with a nucleic acid encoding the iron hydrogenase containing the at least one substitution; and
   c. screening or selecting the transformed organism for the ability to produce hydrogen in the presence of more than 0.5% oxygen.

2. The method of claim 1, wherein the amino acid F is substituted.

3. The method of claim 1, wherein the amino acid $X^1$ is substituted.

4. The method of claim 1, wherein the amino acid $X^2$ is substituted.

5. The method of claim 1, wherein the amino acid $X^3$ is substituted.

6. The method of claim 1, wherein the amino acid $G^1$ is substituted.

7. The method of claim 1, wherein the amino acid $G^2$ is substituted.

8. The method of claim 1, wherein the amino acid V is substituted.

9. The method of claim 1, wherein the amino acid M is substituted.

10. The method of claim 1, wherein the amino acid E is substituted.

11. The method of claim 1, wherein the amino acid $A^1$ is substituted.

12. The method of claim 1, wherein the amino acid $A^2$ is substituted.

13. The method of claim 1, wherein the amino acid $X^4$ is substituted.

14. The method of claim 1, wherein the amino acid R is substituted.

15. The method of claim 2, wherein the substitution is conservative.

16. The method of claim 2, wherein the substitution is non-conservative.

17. The method of claim 3, wherein the substitution is conservative.

18. The method of claim 3, wherein the substitution is non-conservative.

19. The method of claim 4, wherein the substitution is conservative.

20. The method of claim 4, wherein the substitution is non-conservative.

21. The method of claim 5, wherein the substitution is conservative.

22. The method of claim 5, wherein the substitution is non-conservative.

23. The method of claim 6, wherein the substitution is conservative.

24. The method of claim 6, wherein the substitution is non-conservative.

25. The method of claim 7, wherein the substitution is conservative.

26. The method of claim 7, wherein the substitution is non-conservative.

27. The method of claim 8, wherein the substitution is conservative.

28. The method of claim 8, wherein the substitution is non-conservative.

29. The method of claim 9, wherein the substitution is conservative.

30. The method of claim 9, wherein the substitution is non-conservative.

31. The method of claim 10, wherein the substitution is conservative.

32. The method of claim 10, wherein the substitution is non-conservative.

33. The method of claim 11, wherein the substitution is conservative.

34. The method of claim 11, wherein the substitution is non-conservative.

35. The method of claim 12, wherein the substitution is conservative.

36. The method of claim 12, wherein the substitution is non-conservative.

37. The method of claim 13, wherein the substitution is conservative.

38. The method of claim 13, wherein the substitution is non-conservative.

39. The method of claim 14, wherein the substitution is conservative.

40. The method of claim 14, wherein the substitution is non-conservative.

41. The method of claim 1, wherein screening the transformed organism occurs in the presence of an oxygen concentration selected from the list consisting of 2%, 2.5%, 5%, 8%, 10%, 12%, 15%, 20% and approximately 21%.

42. The method of claim 1, wherein at least one oligonucleotide encoding a variant of the $FX^1X^2X^3G^1G^2VMEA^1A^2X^4R$ (SEQ ID NO: 347) segment of an iron hydrogenase is included in an annealing-based recombination reaction to generate the nucleic acid.

43. The method of claim 42, wherein a plurality of oligonucleotides encoding variants of the $FX^1X^2X^3G^1G^2VMEA^2X^4R$ (SEQ ID NO: 347) segment are placed in the reaction in a higher proportion than other oligonucleotides encoding other regions of the iron hydrogenase.

44. The method of claim 42, wherein at least one oligonucleotide encodes at least part of a $FX^1X^2X^3G^1G^2VMEA^1A^2X^4R$ (SEQ ID NO: 347) segment that does not occur in SEQ ID NOs: 1–87.

45. The method of claim 42, wherein oligonucleotides encoding all possible amino acids at one or more positions of the $FX^1X^2X^3G^1G^2VMEA^1A^2X^4R$ (SEQ ID NO: 347) segment are included in the reaction.

46. The method of claim 42, wherein the reaction includes at least one nucleotide sequence that has been recoded.

47. The method of claim 1, wherein the screening or selecting occurs in liquid culture media.

48. The method of claim 47, wherein the culture media is minimal media and the organism is photosynthetic.

49. The method of claim 1, further comprising:
   d. mating a first strain of the organism that (i) has been transformed with an iron hydrogenase containing a substitution in the $FX^1X^2X^3G^1G^2VMEA^1A^2X^4R$ (SEQ ID NO: 347) segment; and (ii) has ability to generate hydrogen in more than 0.5% oxygen to at least a second strain of different genetic background; and
   e. screening or selecting the progeny of the mating for the ability to generate more hydrogen than the first or second strain.

50. The method of claim 49, wherein the mating reaction contains more than two strains of organisms that have different genetic backgrounds.

51. The method of claim 1, wherein hydrogen production is measured at least two times under shifting light and temperature conditions.

52. The method of claim 46, wherein the nucleotide sequence has been recoded to the most preferred codons of the organism.

53. The method of claim 1, wherein the iron hydrogenase of step (a) is selected from SEQ ID NOs: 1–87.

54. The method of claim 1, wherein the iron hydrogenase of step (a), when compared to SEQ ID NO:24 using the BLAST algorithm under the parameters:
   (i) Matrix: BLOSUM62;
   (ii) Gap Penalties: Existence: 11
   (iii) Extension: 1
generates an E value of $4^{e-05}$ or smaller.

55. The method of claim 1, wherein hydrogen production is measured at a plurality of time points.

56. The method of claim 1, wherein hydrogen production is measured under a higher temperature and light intensity than a previous period of time under which the organism has been cultured at a lower temperature and lower light intensity.

57. The method of claim 1, wherein all possible amino acids at one or more positions of the $FX^1X^2X^3G^1G^2VMEA^1A^2X^4R$ (SEQ ID NO: 347) segment are substituted.

58. The method of claim 1, wherein the organism is selected from the list consisting of *Chlamydomonas reinhardtii*, *Escherichia coli*, photosynthetic bacteria, cyanobacteria, and bacteria.

59. The method of claim 58, wherein the organism is *Chlamydomonas reinhardtii*.

60. The method of claim 1, wherein the screening is performed using a chemochromic sensing film that contains a transition metal.

61. The method of claim 46, wherein all nucleotide sequences in the reaction have been recoded to preferred codons of the organism.

62. The method of claim 61, wherein all nucleotide sequences in the reaction have been recoded to most preferred codons of the organism.

* * * * *